United States Patent 10,968,269 (MHC MULTIMERS IN BORRELIA DIAGNOSTICS AND DISEASE) - sequence listing, part 7

SEQ ID NO: 208727 - protein, 15 aa, Borrelia afzelii
GELVLDFAELARDPS

SEQ ID NO: 208728 - protein, 15 aa, Borrelia afzelii
ELVLDFAELARDPSS

SEQ ID NO: 208729 - protein, 15 aa, Borrelia afzelii
LVLDFAELARDPSST

SEQ ID NO: 208730 - protein, 15 aa, Borrelia afzelii
VLDFAELARDPSSTK

SEQ ID NO: 208731 - protein, 15 aa, Borrelia afzelii
LDFAELARDPSSTKL

SEQ ID NO: 208732 - protein, 15 aa, Borrelia afzelii
DFAELARDPSSTKLD

SEQ ID NO: 208733 - protein, 15 aa, Borrelia afzelii
FAELARDPSSTKLDL

SEQ ID NO: 208734 - protein, 15 aa, Borrelia afzelii
AELARDPSSTKLDLT

SEQ ID NO: 208735 - protein, 15 aa, Borrelia afzelii
ELARDPSSTKLDLTN

SEQ ID NO: 208736 - protein, 15 aa, Borrelia afzelii
LARDPSSTKLDLTNY

SEQ ID NO: 208737 - protein, 15 aa, Borrelia afzelii
ARDPSSTKLDLTNYV

SEQ ID NO: 208738 - protein, 15 aa, Borrelia afzelii
RDPSSTKLDLTNYVD

SEQ ID NO: 208739 - protein, 15 aa, Borrelia afzelii
DPSSTKLDLTNYVDY

SEQ ID NO: 208740 - protein, 15 aa, Borrelia afzelii
PSSTKLDLTNYVDYV

SEQ ID NO: 208741 - protein, 15 aa, Borrelia afzelii
SSTKLDLTNYVDYVY

SEQ ID NO: 208742 - protein, 15 aa, Borrelia afzelii
STKLDLTNYVDYVYS

SEQ ID NO: 208743 - protein, 15 aa, Borrelia afzelii
TKLDLTNYVDYVYSG

SEQ ID NO: 208744 - protein, 15 aa, Borrelia afzelii
KLDLTNYVDYVYSGA

SEQ ID NO: 208745 - protein, 15 aa, Borrelia afzelii
LDLTNYVDYVYSGAS

SEQ ID NO: 208746 - protein, 15 aa, Borrelia afzelii
DLTNYVDYVYSGASG

SEQ ID NO: 208747 - protein, 15 aa, Borrelia afzelii
LTNYVDYVYSGASGI

SEQ ID NO: 208748 - protein, 15 aa, Borrelia afzelii
TNYVDYVYSGASGIV

SEQ ID NO: 208749 - protein, 15 aa, Borrelia afzelii
NYVDYVYSGASGIVK

SEQ ID NO: 208750 - protein, 15 aa, Borrelia afzelii
YVDYVYSGASGIVKP

SEQ ID NO: 208751 - protein, 15 aa, Borrelia afzelii
VDYVYSGASGIVKPE

SEQ ID NO: 208752 - protein, 15 aa, Borrelia afzelii
DYVYSGASGIVKPED

SEQ ID NO: 208753 - protein, 15 aa, Borrelia afzelii
YVYSGASGIVKPEDM

SEQ ID NO: 208754 - protein, 15 aa, Borrelia afzelii
VYSGASGIVKPEDMV

SEQ ID NO: 208755 - protein, 15 aa, Borrelia afzelii
YSGASGIVKPEDMVV

SEQ ID NO: 208756 - protein, 15 aa, Borrelia afzelii
SGASGIVKPEDMVVD

SEQ ID NO: 208757 - protein, 15 aa, Borrelia afzelii
GASGIVKPEDMVVDL

SEQ ID NO: 208758 - protein, 15 aa, Borrelia afzelii
ASGIVKPEDMVVDLG

SEQ ID NO: 208759 - protein, 15 aa, Borrelia afzelii
SGIVKPEDMVVDLGI

SEQ ID NO: 208760 - protein, 15 aa, Borrelia afzelii
GIVKPEDMVVDLGIS

SEQ ID NO: 208761 - protein, 15 aa, Borrelia afzelii
IVKPEDMVVDLGISN

SEQ ID NO: 208762 - protein, 15 aa, Borrelia afzelii
VKPEDMVVDLGISNW

SEQ ID NO: 208763 - protein, 15 aa, Borrelia afzelii
KPEDMVVDLGISNWS

SEQ ID NO: 208764 - protein, 15 aa, Borrelia afzelii
PEDMVVDLGISNWSV

SEQ ID NO: 208765 - protein, 15 aa, Borrelia afzelii
EDMVVDLGISNWSVL

SEQ ID NO: 208766 - protein, 15 aa, Borrelia afzelii
DMVVDLGISNWSVLL

SEQ ID NO: 208767 - protein, 15 aa, Borrelia afzelii
MVVDLGISNWSVLLT

SEQ ID NO: 208768 - protein, 15 aa, Borrelia afzelii
VVDLGISNWSVLLTP

SEQ ID NO: 208769 - protein, 15 aa, Borrelia afzelii
VDLGISNWSVLLTPS

SEQ ID NO: 208770 - protein, 15 aa, Borrelia afzelii
DLGISNWSVLLTPSA

SEQ ID NO: 208771 - protein, 15 aa, Borrelia afzelii
LGISNWSVLLTPSAR

SEQ ID NO: 208772 - protein, 15 aa, Borrelia afzelii
GISNWSVLLTPSARL

SEQ ID NO: 208773 - protein, 15 aa, Borrelia afzelii
ISNWSVLLTPSARLQ

SEQ ID NO: 208774 - protein, 15 aa, Borrelia afzelii
SNWSVLLTPSARLQA

SEQ ID NO: 208775 - protein, 15 aa, Borrelia afzelii
NWSVLLTPSARLQAY

SEQ ID NO: 208776 - protein, 15 aa, Borrelia afzelii
WSVLLTPSARLQAYV

SEQ ID NO: 208777 - protein, 15 aa, Borrelia afzelii
SVLLTPSARLQAYVK

SEQ ID NO: 208778 - protein, 15 aa, Borrelia afzelii
VLLTPSARLQAYVKN

SEQ ID NO: 208779 - protein, 15 aa, Borrelia afzelii
LLTPSARLQAYVKNS

SEQ ID NO: 208780 - protein, 15 aa, Borrelia afzelii
LTPSARLQAYVKNSV

SEQ ID NO: 208781 - protein, 15 aa, Borrelia afzelii
TPSARLQAYVKNSVV

SEQ ID NO: 208782 - protein, 15 aa, Borrelia afzelii
PSARLQAYVKNSVVA

SEQ ID NO: 208783 - protein, 15 aa, Borrelia afzelii
SARLQAYVKNSVVAP

SEQ ID NO: 208784 - protein, 15 aa, Borrelia afzelii
ARLQAYVKNSVVAPA

SEQ ID NO: 208785 - protein, 15 aa, Borrelia afzelii
RLQAYVKNSVVAPAL

SEQ ID NO: 208786 - protein, 15 aa, Borrelia afzelii
LQAYVKNSVVAPALV

SEQ ID NO: 208787 - protein, 15 aa, Borrelia afzelii
QAYVKNSVVAPALVK

SEQ ID NO: 208788 - protein, 15 aa, Borrelia afzelii
AYVKNSVVAPALVKS

SEQ ID NO: 208789 - protein, 15 aa, Borrelia afzelii
YVKNSVVAPALVKSE

SEQ ID NO: 208790 - protein, 15 aa, Borrelia afzelii
VKNSVVAPALVKSES

SEQ ID NO: 208791 - protein, 15 aa, Borrelia afzelii
KNSVVAPALVKSESK

SEQ ID NO: 208792 - protein, 15 aa, Borrelia afzelii
NSVVAPALVKSESKR

SEQ ID NO: 208793 - protein, 15 aa, Borrelia afzelii
SVVAPALVKSESKRY

SEQ ID NO: 208794 - protein, 15 aa, Borrelia afzelii
VVAPALVKSESKRYA

SEQ ID NO: 208795 - protein, 15 aa, Borrelia afzelii
VAPALVKSESKRYAG

SEQ ID NO: 208796 - protein, 15 aa, Borrelia afzelii
APALVKSESKRYAGD

SEQ ID NO: 208797 - protein, 15 aa, Borrelia afzelii
PALVKSESKRYAGDT

SEQ ID NO: 208798 - protein, 15 aa, Borrelia afzelii
ALVKSESKRYAGDTI

SEQ ID NO: 208799 - protein, 15 aa, Borrelia afzelii
LVKSESKRYAGDTIL

SEQ ID NO: 208800 - protein, 15 aa, Borrelia afzelii
VKSESKRYAGDTILG

SEQ ID NO: 208801 - protein, 15 aa, Borrelia afzelii
KSESKRYAGDTILGV

SEQ ID NO: 208802 - protein, 15 aa, Borrelia afzelii
SESKRYAGDTILGVR

SEQ ID NO: 208803 - protein, 15 aa, Borrelia afzelii
ESKRYAGDTILGVRV

SEQ ID NO: 208804 - protein, 15 aa, Borrelia afzelii
SKRYAGDTILGVRVL

SEQ ID NO: 208805 - protein, 15 aa, Borrelia afzelii
KRYAGDTILGVRVLF

SEQ ID NO: 208806 - protein, 15 aa, Borrelia afzelii
RYAGDTILGVRVLFP

SEQ ID NO: 208807 - protein, 15 aa, Borrelia afzelii
YAGDTILGVRVLFPS

SEQ ID NO: 208808 - protein, 15 aa, Borrelia afzelii
AGDTILGVRVLFPSY

SEQ ID NO: 208809 - protein, 15 aa, Borrelia afzelii
GDTILGVRVLFPSYS

SEQ ID NO: 208810 - protein, 15 aa, Borrelia afzelii
DTILGVRVLFPSYSQ

SEQ ID NO: 208811 - protein, 15 aa, Borrelia afzelii
TILGVRVLFPSYSQS

SEQ ID NO: 208812 - protein, 15 aa, Borrelia afzelii
ILGVRVLFPSYSQSS

SEQ ID NO: 208813 - protein, 15 aa, Borrelia afzelii
LGVRVLFPSYSQSSA

SEQ ID NO: 208814 - protein, 15 aa, Borrelia afzelii
GVRVLFPSYSQSSAM

SEQ ID NO: 208815 - protein, 15 aa, Borrelia afzelii
VRVLFPSYSQSSAMI

SEQ ID NO: 208816 - protein, 15 aa, Borrelia afzelii
RVLFPSYSQSSAMIM

SEQ ID NO: 208817 - protein, 15 aa, Borrelia afzelii
VLFPSYSQSSAMIMP

SEQ ID NO: 208818 - protein, 15 aa, Borrelia afzelii
LFPSYSQSSAMIMPP

SEQ ID NO: 208819 - protein, 15 aa, Borrelia afzelii
FPSYSQSSAMIMPPF

SEQ ID NO: 208820 - protein, 15 aa, Borrelia afzelii
PSYSQSSAMIMPPFK

SEQ ID NO: 208821 - protein, 15 aa, Borrelia afzelii
SYSQSSAMIMPPFKI

SEQ ID NO: 208822 - protein, 15 aa, Borrelia afzelii
YSQSSAMIMPPFKIP

SEQ ID NO: 208823 - protein, 15 aa, Borrelia afzelii
SQSSAMIMPPFKIPF

SEQ ID NO: 208824 - protein, 15 aa, Borrelia afzelii
QSSAMIMPPFKIPFY

SEQ ID NO: 208825 - protein, 15 aa, Borrelia afzelii
SSAMIMPPFKIPFYS

SEQ ID NO: 208826 - protein, 15 aa, Borrelia afzelii
SAMIMPPFKIPFYSG

SEQ ID NO: 208827 - protein, 15 aa, Borrelia afzelii
AMIMPPFKIPFYSGE

SEQ ID NO: 208828 - protein, 15 aa, Borrelia afzelii
MIMPPFKIPFYSGES

SEQ ID NO: 208829 - protein, 15 aa, Borrelia afzelii
IMPPFKIPFYSGESG

SEQ ID NO: 208830 - protein, 15 aa, Borrelia afzelii
MPPFKIPFYSGESGN

SEQ ID NO: 208831 - protein, 15 aa, Borrelia afzelii
PPFKIPFYSGESGNQ

SEQ ID NO: 208832 - protein, 15 aa, Borrelia afzelii
PFKIPFYSGESGNQF

SEQ ID NO: 208833 - protein, 15 aa, Borrelia afzelii
FKIPFYSGESGNQFL

SEQ ID NO: 208834 - protein, 15 aa, Borrelia afzelii
KIPFYSGESGNQFLG

SEQ ID NO: 208835 - protein, 15 aa, Borrelia afzelii
IPFYSGESGNQFLGK

SEQ ID NO: 208836 - protein, 15 aa, Borrelia afzelii
PFYSGESGNQFLGKG

SEQ ID NO: 208837 - protein, 15 aa, Borrelia afzelii
FYSGESGNQFLGKGL

SEQ ID NO: 208838 - protein, 15 aa, Borrelia afzelii
YSGESGNQFLGKGLI

SEQ ID NO: 208839 - protein, 15 aa, Borrelia afzelii
SGESGNQFLGKGLID

SEQ ID NO: 208840 - protein, 15 aa, Borrelia afzelii
GESGNQFLGKGLIDN

SEQ ID NO: 208841 - protein, 15 aa, Borrelia afzelii
ESGNQFLGKGLIDNI

SEQ ID NO: 208842 - protein, 15 aa, Borrelia afzelii
SGNQFLGKGLIDNIK

SEQ ID NO: 208843 - protein, 15 aa, Borrelia afzelii
GNQFLGKGLIDNIKT

SEQ ID NO: 208844 - protein, 15 aa, Borrelia afzelii
NQFLGKGLIDNIKTM

SEQ ID NO: 208845 - protein, 15 aa, Borrelia afzelii
QFLGKGLIDNIKTMK

SEQ ID NO: 208846 - protein, 15 aa, Borrelia afzelii
FLGKGLIDNIKTMKE

SEQ ID NO: 208847 - protein, 15 aa, Borrelia afzelii
LGKGLIDNIKTMKEI

SEQ ID NO: 208848 - protein, 15 aa, Borrelia afzelii
GKGLIDNIKTMKEIK

SEQ ID NO: 208849 - protein, 15 aa, Borrelia afzelii
KGLIDNIKTMKEIKV

SEQ ID NO: 208850 - protein, 15 aa, Borrelia afzelii
GLIDNIKTMKEIKVS

SEQ ID NO: 208851 - protein, 15 aa, Borrelia afzelii
LIDNIKTMKEIKVSV

SEQ ID NO: 208852 - protein, 15 aa, Borrelia afzelii
IDNIKTMKEIKVSVY

SEQ ID NO: 208853 - protein, 15 aa, Borrelia afzelii
DNIKTMKEIKVSVYS

SEQ ID NO: 208854 - protein, 15 aa, Borrelia afzelii
NIKTMKEIKVSVYSL

SEQ ID NO: 208855 - protein, 15 aa, Borrelia afzelii
IKTMKEIKVSVYSLG

SEQ ID NO: 208856 - protein, 15 aa, Borrelia afzelii
KTMKEIKVSVYSLGY

SEQ ID NO: 208857 - protein, 15 aa, Borrelia afzelii
TMKEIKVSVYSLGYE

SEQ ID NO: 208858 - protein, 15 aa, Borrelia afzelii
MKEIKVSVYSLGYEV

SEQ ID NO: 208859 - protein, 15 aa, Borrelia afzelii
KEIKVSVYSLGYEVD

SEQ ID NO: 208860 - protein, 15 aa, Borrelia afzelii
EIKVSVYSLGYEVDL

SEQ ID NO: 208861 - protein, 15 aa, Borrelia afzelii
IKVSVYSLGYEVDLE

SEQ ID NO: 208862 - protein, 15 aa, Borrelia afzelii
KVSVYSLGYEVDLEV

SEQ ID NO: 208863 - protein, 15 aa, Borrelia afzelii
VSVYSLGYEVDLEVL

SEQ ID NO: 208864 - protein, 15 aa, Borrelia afzelii
SVYSLGYEVDLEVLF

SEQ ID NO: 208865 - protein, 15 aa, Borrelia afzelii
VYSLGYEVDLEVLFE

SEQ ID NO: 208866 - protein, 15 aa, Borrelia afzelii
YSLGYEVDLEVLFED

SEQ ID NO: 208867 - protein, 15 aa, Borrelia afzelii
SLGYEVDLEVLFEDM

SEQ ID NO: 208868 - protein, 15 aa, Borrelia afzelii
LGYEVDLEVLFEDMN

SEQ ID NO: 208869 - protein, 15 aa, Borrelia afzelii
GYEVDLEVLFEDMNG

SEQ ID NO: 208870 - protein, 15 aa, Borrelia afzelii
YEVDLEVLFEDMNGM

SEQ ID NO: 208871 - protein, 15 aa, Borrelia afzelii
EVDLEVLFEDMNGME

SEQ ID NO: 208872 - protein, 15 aa, Borrelia afzelii
VDLEVLFEDMNGMEY

SEQ ID NO: 208873 - protein, 15 aa, Borrelia afzelii
DLEVLFEDMNGMEYA

SEQ ID NO: 208874 - protein, 15 aa, Borrelia afzelii
LEVLFEDMNGMEYAY

SEQ ID NO: 208875 - protein, 15 aa, Borrelia afzelii
EVLFEDMNGMEYAYS

SEQ ID NO: 208876 - protein, 15 aa, Borrelia afzelii
VLFEDMNGMEYAYSL

SEQ ID NO: 208877 - protein, 15 aa, Borrelia afzelii
LFEDMNGMEYAYSLG

SEQ ID NO: 208878 - protein, 15 aa, Borrelia afzelii
FEDMNGMEYAYSLGT

SEQ ID NO: 208879 - protein, 15 aa, Borrelia afzelii
EDMNGMEYAYSLGTL

SEQ ID NO: 208880 - protein, 15 aa, Borrelia afzelii
DMNGMEYAYSLGTLK

SEQ ID NO: 208881 - protein, 15 aa, Borrelia afzelii
MNGMEYAYSLGTLKF

SEQ ID NO: 208882 - protein, 15 aa, Borrelia afzelii
NGMEYAYSLGTLKFK

SEQ ID NO: 208883 - protein, 15 aa, Borrelia afzelii
GMEYAYSLGTLKFKG

SEQ ID NO: 208884 - protein, 15 aa, Borrelia afzelii
MEYAYSLGTLKFKGW

SEQ ID NO: 208885 - protein, 15 aa, Borrelia afzelii
EYAYSLGTLKFKGWA

SEQ ID NO: 208886 - protein, 15 aa, Borrelia afzelii
YAYSLGTLKFKGWAD

SEQ ID NO: 208887 - protein, 15 aa, Borrelia afzelii
AYSLGTLKFKGWADL

SEQ ID NO: 208888 - protein, 15 aa, Borrelia afzelii
YSLGTLKFKGWADLI

SEQ ID NO: 208889 - protein, 15 aa, Borrelia afzelii
SLGTLKFKGWADLIW

SEQ ID NO: 208890 - protein, 15 aa, Borrelia afzelii
LGTLKFKGWADLIWS

SEQ ID NO: 208891 - protein, 15 aa, Borrelia afzelii
GTLKFKGWADLIWSN

SEQ ID NO: 208892 - protein, 15 aa, Borrelia afzelii
TLKFKGWADLIWSNP

SEQ ID NO: 208893 - protein, 15 aa, Borrelia afzelii
LKFKGWADLIWSNPN

SEQ ID NO: 208894 - protein, 15 aa, Borrelia afzelii
KFKGWADLIWSNPNY

SEQ ID NO: 208895 - protein, 15 aa, Borrelia afzelii
FKGWADLIWSNPNYI

SEQ ID NO: 208896 - protein, 15 aa, Borrelia afzelii
KGWADLIWSNPNYIP

SEQ ID NO: 208897 - protein, 15 aa, Borrelia afzelii
GWADLIWSNPNYIPN

SEQ ID NO: 208898 - protein, 15 aa, Borrelia afzelii
WADLIWSNPNYIPNI

SEQ ID NO: 208899 - protein, 15 aa, Borrelia afzelii
ADLIWSNPNYIPNIS

SEQ ID NO: 208900 - protein, 15 aa, Borrelia afzelii
DLIWSNPNYIPNISA

SEQ ID NO: 208901 - protein, 15 aa, Borrelia afzelii
LIWSNPNYIPNISAR

SEQ ID NO: 208902 - protein, 15 aa, Borrelia afzelii
IWSNPNYIPNISARI

SEQ ID NO: 208903 - protein, 15 aa, Borrelia afzelii
WSNPNYIPNISARII

SEQ ID NO: 208904 - protein, 15 aa, Borrelia afzelii
SNPNYIPNISARIIK

SEQ ID NO: 208905 - protein, 15 aa, Borrelia afzelii
NPNYIPNISARIIKD

SEQ ID NO: 208906 - protein, 15 aa, Borrelia afzelii
PNYIPNISARIIKDD

SEQ ID NO: 208907 - protein, 15 aa, Borrelia afzelii
NYIPNISARIIKDDV

SEQ ID NO: 208908 - protein, 15 aa, Borrelia afzelii
YIPNISARIIKDDVP

SEQ ID NO: 208909 - protein, 15 aa, Borrelia afzelii
IPNISARIIKDDVPN

SEQ ID NO: 208910 - protein, 15 aa, Borrelia afzelii
PNISARIIKDDVPNY

SEQ ID NO: 208911 - protein, 15 aa, Borrelia afzelii
NISARIIKDDVPNYP

SEQ ID NO: 208912 - protein, 15 aa, Borrelia afzelii
ISARIIKDDVPNYPL

SEQ ID NO: 208913 - protein, 15 aa, Borrelia afzelii
SARIIKDDVPNYPLA

SEQ ID NO: 208914 - protein, 15 aa, Borrelia afzelii
ARIIKDDVPNYPLAS

SEQ ID NO: 208915 - protein, 15 aa, Borrelia afzelii
RIIKDDVPNYPLASS

SEQ ID NO: 208916 - protein, 15 aa, Borrelia afzelii
IIKDDVPNYPLASSK

SEQ ID NO: 208917 - protein, 15 aa, Borrelia afzelii
IKDDVPNYPLASSKM

SEQ ID NO: 208918 - protein, 15 aa, Borrelia afzelii
KDDVPNYPLASSKMR

SEQ ID NO: 208919 - protein, 15 aa, Borrelia afzelii
DDVPNYPLASSKMRF

SEQ ID NO: 208920 - protein, 15 aa, Borrelia afzelii
DVPNYPLASSKMRFK

SEQ ID NO: 208921 - protein, 15 aa, Borrelia afzelii
VPNYPLASSKMRFKA

SEQ ID NO: 208922 - protein, 15 aa, Borrelia afzelii
PNYPLASSKMRFKAF

SEQ ID NO: 208923 - protein, 15 aa, Borrelia afzelii
NYPLASSKMRFKAFR

SEQ ID NO: 208924 - protein, 15 aa, Borrelia afzelii
YPLASSKMRFKAFRV

SEQ ID NO: 208925 - protein, 15 aa, Borrelia afzelii
PLASSKMRFKAFRVS

SEQ ID NO: 208926 - protein, 15 aa, Borrelia afzelii
LASSKMRFKAFRVSK

SEQ ID NO: 208927 - protein, 15 aa, Borrelia afzelii
ASSKMRFKAFRVSKS

SEQ ID NO: 208928 - protein, 15 aa, Borrelia afzelii
SSKMRFKAFRVSKSH

SEQ ID NO: 208929 - protein, 15 aa, Borrelia afzelii
SKMRFKAFRVSKSHS

SEQ ID NO: 208930 - protein, 15 aa, Borrelia afzelii
KMRFKAFRVSKSHSS

SEQ ID NO: 208931 - protein, 15 aa, Borrelia afzelii
MRFKAFRVSKSHSSK

SEQ ID NO: 208932 - protein, 15 aa, Borrelia afzelii
RFKAFRVSKSHSSKE

SEQ ID NO: 208933 - protein, 15 aa, Borrelia afzelii
FKAFRVSKSHSSKEQ

SEQ ID NO: 208934 - protein, 15 aa, Borrelia afzelii
KAFRVSKSHSSKEQN

SEQ ID NO: 208935 - protein, 15 aa, Borrelia afzelii
AFRVSKSHSSKEQNF

SEQ ID NO: 208936 - protein, 15 aa, Borrelia afzelii
FRVSKSHSSKEQNFI

SEQ ID NO: 208937 - protein, 15 aa, Borrelia afzelii
RVSKSHSSKEQNFIF

SEQ ID NO: 208938 - protein, 15 aa, Borrelia afzelii
VSKSHSSKEQNFIFY

SEQ ID NO: 208939 - protein, 15 aa, Borrelia afzelii
SKSHSSKEQNFIFYV

SEQ ID NO: 208940 - protein, 15 aa, Borrelia afzelii
KSHSSKEQNFIFYVK

SEQ ID NO: 208941 - protein, 15 aa, Borrelia afzelii
SHSSKEQNFIFYVKD

SEQ ID NO: 208942 - protein, 15 aa, Borrelia afzelii
HSSKEQNFIFYVKDL

SEQ ID NO: 208943 - protein, 15 aa, Borrelia afzelii
SSKEQNFIFYVKDLR

SEQ ID NO: 208944 - protein, 15 aa, Borrelia afzelii
SKEQNFIFYVKDLRV

SEQ ID NO: 208945 - protein, 15 aa, Borrelia afzelii
KEQNFIFYVKDLRVL

SEQ ID NO: 208946 - protein, 15 aa, Borrelia afzelii
EQNFIFYVKDLRVLY

SEQ ID NO: 208947 - protein, 15 aa, Borrelia afzelii
QNFIFYVKDLRVLYD

SEQ ID NO: 208948 - protein, 15 aa, Borrelia afzelii
NFIFYVKDLRVLYDK

SEQ ID NO: 208949 - protein, 15 aa, Borrelia afzelii
FIFYVKDLRVLYDKL

SEQ ID NO: 208950 - protein, 15 aa, Borrelia afzelii
IFYVKDLRVLYDKLS

SEQ ID NO: 208951 - protein, 15 aa, Borrelia afzelii
FYVKDLRVLYDKLSV

SEQ ID NO: 208952 - protein, 15 aa, Borrelia afzelii
YVKDLRVLYDKLSVS

SEQ ID NO: 208953 - protein, 15 aa, Borrelia afzelii
VKDLRVLYDKLSVSI

SEQ ID NO: 208954 - protein, 15 aa, Borrelia afzelii
KDLRVLYDKLSVSID

SEQ ID NO: 208955 - protein, 15 aa, Borrelia afzelii
DLRVLYDKLSVSIDS

SEQ ID NO: 208956 - protein, 15 aa, Borrelia afzelii
LRVLYDKLSVSIDSD

SEQ ID NO: 208957 - protein, 15 aa, Borrelia afzelii
RVLYDKLSVSIDSDI

SEQ ID NO: 208958 - protein, 15 aa, Borrelia afzelii
VLYDKLSVSIDSDID

SEQ ID NO: 208959 - protein, 15 aa, Borrelia afzelii
LYDKLSVSIDSDIDS

SEQ ID NO: 208960 - protein, 15 aa, Borrelia afzelii
YDKLSVSIDSDIDSE

SEQ ID NO: 208961 - protein, 15 aa, Borrelia afzelii
DKLSVSIDSDIDSES

SEQ ID NO: 208962 - protein, 15 aa, Borrelia afzelii
KLSVSIDSDIDSESV

SEQ ID NO: 208963 - protein, 15 aa, Borrelia afzelii
LSVSIDSDIDSESVF

SEQ ID NO: 208964 - protein, 15 aa, Borrelia afzelii
SVSIDSDIDSESVFK

SEQ ID NO: 208965 - protein, 15 aa, Borrelia afzelii
VSIDSDIDSESVFKV

SEQ ID NO: 208966 - protein, 15 aa, Borrelia afzelii
SIDSDIDSESVFKVY

SEQ ID NO: 208967 - protein, 15 aa, Borrelia afzelii
IDSDIDSESVFKVYE

SEQ ID NO: 208968 - protein, 15 aa, Borrelia afzelii
DSDIDSESVFKVYET

SEQ ID NO: 208969 - protein, 15 aa, Borrelia afzelii
SDIDSESVFKVYETS

SEQ ID NO: 208970 - protein, 15 aa, Borrelia afzelii
DIDSESVFKVYETSG

SEQ ID NO: 208971 - protein, 15 aa, Borrelia afzelii
IDSESVFKVYETSGA

SEQ ID NO: 208972 - protein, 15 aa, Borrelia afzelii
DSESVFKVYETSGAE

SEQ ID NO: 208973 - protein, 15 aa, Borrelia afzelii
SESVFKVYETSGAES

SEQ ID NO: 208974 - protein, 15 aa, Borrelia afzelii
ESVFKVYETSGAESL

SEQ ID NO: 208975 - protein, 15 aa, Borrelia afzelii
SVFKVYETSGAESLR

SEQ ID NO: 208976 - protein, 15 aa, Borrelia afzelii
VFKVYETSGAESLRK

SEQ ID NO: 208977 - protein, 15 aa, Borrelia afzelii
FKVYETSGAESLRKL

SEQ ID NO: 208978 - protein, 15 aa, Borrelia afzelii
KVYETSGAESLRKLK

SEQ ID NO: 208979 - protein, 15 aa, Borrelia afzelii
VYETSGAESLRKLKA

SEQ ID NO: 208980 - protein, 15 aa, Borrelia afzelii
YETSGAESLRKLKAH

SEQ ID NO: 208981 - protein, 15 aa, Borrelia afzelii
ETSGAESLRKLKAHE

SEQ ID NO: 208982 - protein, 15 aa, Borrelia afzelii
TSGAESLRKLKAHET

SEQ ID NO: 208983 - protein, 15 aa, Borrelia afzelii
SGAESLRKLKAHETF

SEQ ID NO: 208984 - protein, 15 aa, Borrelia afzelii
GAESLRKLKAHETFK

SEQ ID NO: 208985 - protein, 15 aa, Borrelia afzelii
AESLRKLKAHETFKR

SEQ ID NO: 208986 - protein, 15 aa, Borrelia afzelii
ESLRKLKAHETFKRV

SEQ ID NO: 208987 - protein, 15 aa, Borrelia afzelii
SLRKLKAHETFKRVL

SEQ ID NO: 208988 - protein, 15 aa, Borrelia afzelii
LRKLKAHETFKRVLK

SEQ ID NO: 208989 - protein, 15 aa, Borrelia afzelii
RKLKAHETFKRVLKL

SEQ ID NO: 208990 - protein, 15 aa, Borrelia afzelii
KLKAHETFKRVLKLR

SEQ ID NO: 208991 - protein, 15 aa, Borrelia afzelii
LKAHETFKRVLKLRE

SEQ ID NO: 208992 - protein, 15 aa, Borrelia afzelii
KAHETFKRVLKLREK

SEQ ID NO: 208993 - protein, 15 aa, Borrelia afzelii
AHETFKRVLKLREKI

SEQ ID NO: 208994 - protein, 15 aa, Borrelia afzelii
HETFKRVLKLREKIS

SEQ ID NO: 208995 - protein, 15 aa, Borrelia afzelii
ETFKRVLKLREKISM

SEQ ID NO: 208996 - protein, 15 aa, Borrelia afzelii
TFKRVLKLREKISMP

SEQ ID NO: 208997 - protein, 15 aa, Borrelia afzelii
FKRVLKLREKISMPE

SEQ ID NO: 208998 - protein, 15 aa, Borrelia afzelii
KRVLKLREKISMPEG

SEQ ID NO: 208999 - protein, 15 aa, Borrelia afzelii
RVLKLREKISMPEGS

SEQ ID NO: 209000 - protein, 15 aa, Borrelia afzelii
VLKLREKISMPEGSF

SEQ ID NO: 209001 - protein, 15 aa, Borrelia afzelii
LKLREKISMPEGSFQ

SEQ ID NO: 209002 - protein, 15 aa, Borrelia afzelii
KLREKISMPEGSFQN

SEQ ID NO: 209003 - protein, 15 aa, Borrelia afzelii
LREKISMPEGSFQNF

SEQ ID NO: 209004 - protein, 15 aa, Borrelia afzelii
REKISMPEGSFQNFI

SEQ ID NO: 209005 - protein, 15 aa, Borrelia afzelii
EKISMPEGSFQNFIE

SEQ ID NO: 209006 - protein, 15 aa, Borrelia afzelii
KISMPEGSFQNFIEK

SEQ ID NO: 209007 - protein, 15 aa, Borrelia afzelii
ISMPEGSFQNFIEKV

SEQ ID NO: 209008 - protein, 15 aa, Borrelia afzelii
SMPEGSFQNFIEKVE

SEQ ID NO: 209009 - protein, 15 aa, Borrelia afzelii
MPEGSFQNFIEKVES

SEQ ID NO: 209010 - protein, 15 aa, Borrelia afzelii
PEGSFQNFIEKVESD

SEQ ID NO: 209011 - protein, 15 aa, Borrelia afzelii
EGSFQNFIEKVESDK

SEQ ID NO: 209012 - protein, 15 aa, Borrelia afzelii
GSFQNFIEKVESDKP

SEQ ID NO: 209013 - protein, 15 aa, Borrelia afzelii
SFQNFIEKVESDKPE

SEQ ID NO: 209014 - protein, 15 aa, Borrelia afzelii
FQNFIEKVESDKPEE

SEQ ID NO: 209015 - protein, 15 aa, Borrelia afzelii
QNFIEKVESDKPEES

SEQ ID NO: 209016 - protein, 15 aa, Borrelia afzelii
NFIEKVESDKPEESS

SEQ ID NO: 209017 - protein, 15 aa, Borrelia afzelii
FIEKVESDKPEESSS

SEQ ID NO: 209018 - protein, 15 aa, Borrelia afzelii
IEKVESDKPEESSSE

SEQ ID NO: 209019 - protein, 15 aa, Borrelia afzelii
EKVESDKPEESSSEN

SEQ ID NO: 209020 - protein, 16 aa, Borrelia afzelii
MKRKAKSILFFLLSTA

SEQ ID NO: 209021 - protein, 16 aa, Borrelia afzelii
KRKAKSILFFLLSTAL

SEQ ID NO: 209022 - protein, 16 aa, Borrelia afzelii
RKAKSILFFLLSTALF

SEQ ID NO: 209023 - protein, 16 aa, Borrelia afzelii
KAKSILFFLLSTALFA

SEQ ID NO: 209024 - protein, 16 aa, Borrelia afzelii
AKSILFFLLSTALFAQ

SEQ ID NO: 209025 - protein, 16 aa, Borrelia afzelii
KSILFFLLSTALFAQE

SEQ ID NO: 209026 - protein, 16 aa, Borrelia afzelii
SILFFLLSTALFAQET

SEQ ID NO: 209027 - protein, 16 aa, Borrelia afzelii
ILFFLLSTALFAQETD

SEQ ID NO: 209028 - protein, 16 aa, Borrelia afzelii
LFFLLSTALFAQETDG

SEQ ID NO: 209029 - protein, 16 aa, Borrelia afzelii
FFLLSTALFAQETDGL

SEQ ID NO: 209030 - protein, 16 aa, Borrelia afzelii
FLLSTALFAQETDGLT

SEQ ID NO: 209031 - protein, 16 aa, Borrelia afzelii
LLSTALFAQETDGLTE

SEQ ID NO: 209032 - protein, 16 aa, Borrelia afzelii
LSTALFAQETDGLTEG

SEQ ID NO: 209033 - protein, 16 aa, Borrelia afzelii
STALFAQETDGLTEGS

SEQ ID NO: 209034 - protein, 16 aa, Borrelia afzelii
TALFAQETDGLTEGSK

SEQ ID NO: 209035 - protein, 16 aa, Borrelia afzelii
ALFAQETDGLTEGSKR

SEQ ID NO: 209036 - protein, 16 aa, Borrelia afzelii
LFAQETDGLTEGSKRA

SEQ ID NO: 209037 - protein, 16 aa, Borrelia afzelii
FAQETDGLTEGSKRAE

SEQ ID NO: 209038 - protein, 16 aa, Borrelia afzelii
AQETDGLTEGSKRAEP

SEQ ID NO: 209039 - protein, 16 aa, Borrelia afzelii
QETDGLTEGSKRAEPG

SEQ ID NO: 209040 - protein, 16 aa, Borrelia afzelii
ETDGLTEGSKRAEPGE

SEQ ID NO: 209041 - protein, 16 aa, Borrelia afzelii
TDGLTEGSKRAEPGEL

SEQ ID NO: 209042 - protein, 16 aa, Borrelia afzelii
DGLTEGSKRAEPGELV

SEQ ID NO: 209043 - protein, 16 aa, Borrelia afzelii
GLTEGSKRAEPGELVL

SEQ ID NO: 209044 - protein, 16 aa, Borrelia afzelii
LTEGSKRAEPGELVLD

SEQ ID NO: 209045 - protein, 16 aa, Borrelia afzelii
TEGSKRAEPGELVLDF

SEQ ID NO: 209046 - protein, 16 aa, Borrelia afzelii
EGSKRAEPGELVLDFA

SEQ ID NO: 209047 - protein, 16 aa, Borrelia afzelii
GSKRAEPGELVLDFAE

SEQ ID NO: 209048 - protein, 16 aa, Borrelia afzelii
SKRAEPGELVLDFAEL

SEQ ID NO: 209049 - protein, 16 aa, Borrelia afzelii
KRAEPGELVLDFAELA

SEQ ID NO: 209050 - protein, 16 aa, Borrelia afzelii
RAEPGELVLDFAELAR

SEQ ID NO: 209051 - protein, 16 aa, Borrelia afzelii
AEPGELVLDFAELARD

SEQ ID NO: 209052 - protein, 16 aa, Borrelia afzelii
EPGELVLDFAELARDP

SEQ ID NO: 209053 - protein, 16 aa, Borrelia afzelii
PGELVLDFAELARDPS

SEQ ID NO: 209054 - protein, 16 aa, Borrelia afzelii
GELVLDFAELARDPSS

SEQ ID NO: 209055 - protein, 16 aa, Borrelia afzelii
ELVLDFAELARDPSST

SEQ ID NO: 209056 - protein, 16 aa, Borrelia afzelii
LVLDFAELARDPSSTK

SEQ ID NO: 209057 - protein, 16 aa, Borrelia afzelii
VLDFAELARDPSSTKL

SEQ ID NO: 209058 - protein, 16 aa, Borrelia afzelii
LDFAELARDPSSTKLD

SEQ ID NO: 209059 - protein, 16 aa, Borrelia afzelii
DFAELARDPSSTKLDL

SEQ ID NO: 209060 - protein, 16 aa, Borrelia afzelii
FAELARDPSSTKLDLT

SEQ ID NO: 209061 - protein, 16 aa, Borrelia afzelii
AELARDPSSTKLDLTN

SEQ ID NO: 209062 - protein, 16 aa, Borrelia afzelii
ELARDPSSTKLDLTNY

SEQ ID NO: 209063 - protein, 16 aa, Borrelia afzelii
LARDPSSTKLDLTNYV

SEQ ID NO: 209064 - protein, 16 aa, Borrelia afzelii
ARDPSSTKLDLTNYVD

SEQ ID NO: 209065 - protein, 16 aa, Borrelia afzelii
RDPSSTKLDLTNYVDY

SEQ ID NO: 209066 - protein, 16 aa, Borrelia afzelii
DPSSTKLDLTNYVDYV

SEQ ID NO: 209067 - protein, 16 aa, Borrelia afzelii
PSSTKLDLTNYVDYVY

SEQ ID NO: 209068 - protein, 16 aa, Borrelia afzelii
SSTKLDLTNYVDYVYS

SEQ ID NO: 209069 - protein, 16 aa, Borrelia afzelii
STKLDLTNYVDYVYSG

SEQ ID NO: 209070 - protein, 16 aa, Borrelia afzelii
TKLDLTNYVDYVYSGA

SEQ ID NO: 209071 - protein, 16 aa, Borrelia afzelii
KLDLTNYVDYVYSGAS

SEQ ID NO: 209072 - protein, 16 aa, Borrelia afzelii
LDLTNYVDYVYSGASG

SEQ ID NO: 209073 - protein, 16 aa, Borrelia afzelii
DLTNYVDYVYSGASGI

SEQ ID NO: 209074 - protein, 16 aa, Borrelia afzelii
LTNYVDYVYSGASGIV

SEQ ID NO: 209075 - protein, 16 aa, Borrelia afzelii
TNYVDYVYSGASGIVK

SEQ ID NO: 209076 - protein, 16 aa, Borrelia afzelii
NYVDYVYSGASGIVKP

SEQ ID NO: 209077 - protein, 16 aa, Borrelia afzelii
YVDYVYSGASGIVKPE

SEQ ID NO: 209078 - protein, 16 aa, Borrelia afzelii
VDYVYSGASGIVKPED

SEQ ID NO: 209079 - protein, 16 aa, Borrelia afzelii
DYVYSGASGIVKPEDM

SEQ ID NO: 209080 - protein, 16 aa, Borrelia afzelii
YVYSGASGIVKPEDMV

SEQ ID NO: 209081 - protein, 16 aa, Borrelia afzelii
VYSGASGIVKPEDMVV

SEQ ID NO: 209082 - protein, 16 aa, Borrelia afzelii
YSGASGIVKPEDMVVD

SEQ ID NO: 209083 - protein, 16 aa, Borrelia afzelii
SGASGIVKPEDMVVDL

SEQ ID NO: 209084 - protein, 16 aa, Borrelia afzelii
GASGIVKPEDMVVDLG

SEQ ID NO: 209085 - protein, 16 aa, Borrelia afzelii
ASGIVKPEDMVVDLGI

SEQ ID NO: 209086 - protein, 16 aa, Borrelia afzelii
SGIVKPEDMVVDLGIS

SEQ ID NO: 209087 - protein, 16 aa, Borrelia afzelii
GIVKPEDMVVDLGISN

SEQ ID NO: 209088 - protein, 16 aa, Borrelia afzelii
IVKPEDMVVDLGISNW

SEQ ID NO: 209089 - protein, 16 aa, Borrelia afzelii
VKPEDMVVDLGISNWS

SEQ ID NO: 209090 - protein, 16 aa, Borrelia afzelii
KPEDMVVDLGISNWSV

SEQ ID NO: 209091 - protein, 16 aa, Borrelia afzelii
PEDMVVDLGISNWSVL

SEQ ID NO: 209092 - protein, 16 aa, Borrelia afzelii
EDMVVDLGISNWSVLL

SEQ ID NO: 209093 - protein, 16 aa, Borrelia afzelii
DMVVDLGISNWSVLLT

SEQ ID NO: 209094 - protein, 16 aa, Borrelia afzelii
MVVDLGISNWSVLLTP

SEQ ID NO: 209095 - protein, 16 aa, Borrelia afzelii
VVDLGISNWSVLLTPS

SEQ ID NO: 209096 - protein, 16 aa, Borrelia afzelii
VDLGISNWSVLLTPSA

SEQ ID NO: 209097 - protein, 16 aa, Borrelia afzelii
DLGISNWSVLLTPSAR

SEQ ID NO: 209098 - protein, 16 aa, Borrelia afzelii
LGISNWSVLLTPSARL

SEQ ID NO: 209099 - protein, 16 aa, Borrelia afzelii
GISNWSVLLTPSARLQ

SEQ ID NO: 209100 - protein, 16 aa, Borrelia afzelii
ISNWSVLLTPSARLQA

SEQ ID NO: 209101 - protein, 16 aa, Borrelia afzelii
SNWSVLLTPSARLQAY

SEQ ID NO: 209102 - protein, 16 aa, Borrelia afzelii
NWSVLLTPSARLQAYV

SEQ ID NO: 209103 - protein, 16 aa, Borrelia afzelii
WSVLLTPSARLQAYVK

SEQ ID NO: 209104 - protein, 16 aa, Borrelia afzelii
SVLLTPSARLQAYVKN

SEQ ID NO: 209105 - protein, 16 aa, Borrelia afzelii
VLLTPSARLQAYVKNS

SEQ ID NO: 209106 - protein, 16 aa, Borrelia afzelii
LLTPSARLQAYVKNSV

SEQ ID NO: 209107 - protein, 16 aa, Borrelia afzelii
LTPSARLQAYVKNSVV

SEQ ID NO: 209108 - protein, 16 aa, Borrelia afzelii
TPSARLQAYVKNSVVA

SEQ ID NO: 209109 - protein, 16 aa, Borrelia afzelii
PSARLQAYVKNSVVAP

SEQ ID NO: 209110 - protein, 16 aa, Borrelia afzelii
SARLQAYVKNSVVAPA

SEQ ID NO: 209111 - protein, 16 aa, Borrelia afzelii
ARLQAYVKNSVVAPAL

SEQ ID NO: 209112 - protein, 16 aa, Borrelia afzelii
RLQAYVKNSVVAPALV

SEQ ID NO: 209113 - protein, 16 aa, Borrelia afzelii
LQAYVKNSVVAPALVK

SEQ ID NO: 209114 - protein, 16 aa, Borrelia afzelii
QAYVKNSVVAPALVKS

SEQ ID NO: 209115 - protein, 16 aa, Borrelia afzelii
AYVKNSVVAPALVKSE

SEQ ID NO: 209116 - protein, 16 aa, Borrelia afzelii
YVKNSVVAPALVKSES

SEQ ID NO: 209117 - protein, 16 aa, Borrelia afzelii
VKNSVVAPALVKSESK

SEQ ID NO: 209118 - protein, 16 aa, Borrelia afzelii
KNSVVAPALVKSESKR

SEQ ID NO: 209119 - protein, 16 aa, Borrelia afzelii
NSVVAPALVKSESKRY

SEQ ID NO: 209120 - protein, 16 aa, Borrelia afzelii
SVVAPALVKSESKRYA

SEQ ID NO: 209121 - protein, 16 aa, Borrelia afzelii
VVAPALVKSESKRYAG

SEQ ID NO: 209122 - protein, 16 aa, Borrelia afzelii
VAPALVKSESKRYAGD

SEQ ID NO: 209123 - protein, 16 aa, Borrelia afzelii
APALVKSESKRYAGDT

SEQ ID NO: 209124 - protein, 16 aa, Borrelia afzelii
PALVKSESKRYAGDTI

SEQ ID NO: 209125 - protein, 16 aa, Borrelia afzelii
ALVKSESKRYAGDTIL

SEQ ID NO: 209126 - protein, 16 aa, Borrelia afzelii
LVKSESKRYAGDTILG

SEQ ID NO: 209127 - protein, 16 aa, Borrelia afzelii
VKSESKRYAGDTILGV

SEQ ID NO: 209128 - protein, 16 aa, Borrelia afzelii
KSESKRYAGDTILGVR

SEQ ID NO: 209129 - protein, 16 aa, Borrelia afzelii
SESKRYAGDTILGVRV

SEQ ID NO: 209130 - protein, 16 aa, Borrelia afzelii
ESKRYAGDTILGVRVL

SEQ ID NO: 209131 - protein, 16 aa, Borrelia afzelii
SKRYAGDTILGVRVLF

SEQ ID NO: 209132 - protein, 16 aa, Borrelia afzelii
KRYAGDTILGVRVLFP

SEQ ID NO: 209133 - protein, 16 aa, Borrelia afzelii
RYAGDTILGVRVLFPS

SEQ ID NO: 209134 - protein, 16 aa, Borrelia afzelii
YAGDTILGVRVLFPSY

SEQ ID NO: 209135 - protein, 16 aa, Borrelia afzelii
AGDTILGVRVLFPSYS

SEQ ID NO: 209136 - protein, 16 aa, Borrelia afzelii
GDTILGVRVLFPSYSQ

SEQ ID NO: 209137 - protein, 16 aa, Borrelia afzelii
DTILGVRVLFPSYSQS

SEQ ID NO: 209138 - protein, 16 aa, Borrelia afzelii
TILGVRVLFPSYSQSS

SEQ ID NO: 209139 - protein, 16 aa, Borrelia afzelii
ILGVRVLFPSYSQSSA

SEQ ID NO: 209140 - protein, 16 aa, Borrelia afzelii
LGVRVLFPSYSQSSAM

SEQ ID NO: 209141 - protein, 16 aa, Borrelia afzelii
GVRVLFPSYSQSSAMI

SEQ ID NO: 209142 - protein, 16 aa, Borrelia afzelii
VRVLFPSYSQSSAMIM

SEQ ID NO: 209143 - protein, 16 aa, Borrelia afzelii
RVLFPSYSQSSAMIMP

SEQ ID NO: 209144 - protein, 16 aa, Borrelia afzelii
VLFPSYSQSSAMIMPP

SEQ ID NO: 209145 - protein, 16 aa, Borrelia afzelii
LFPSYSQSSAMIMPPF

SEQ ID NO: 209146 - protein, 16 aa, Borrelia afzelii
FPSYSQSSAMIMPPFK

SEQ ID NO: 209147 - protein, 16 aa, Borrelia afzelii
PSYSQSSAMIMPPFKI

SEQ ID NO: 209148 - protein, 16 aa, Borrelia afzelii
SYSQSSAMIMPPFKIP

SEQ ID NO: 209149 - protein, 16 aa, Borrelia afzelii
YSQSSAMIMPPFKIPF

SEQ ID NO: 209150 - protein, 16 aa, Borrelia afzelii
SQSSAMIMPPFKIPFY

SEQ ID NO: 209151 - protein, 16 aa, Borrelia afzelii
QSSAMIMPPFKIPFYS

SEQ ID NO: 209152 - protein, 16 aa, Borrelia afzelii
SSAMIMPPFKIPFYSG

SEQ ID NO: 209153 - protein, 16 aa, Borrelia afzelii
SAMIMPPFKIPFYSGE

SEQ ID NO: 209154 - protein, 16 aa, Borrelia afzelii
AMIMPPFKIPFYSGES

SEQ ID NO: 209155 - protein, 16 aa, Borrelia afzelii
MIMPPFKIPFYSGESG

SEQ ID NO: 209156 - protein, 16 aa, Borrelia afzelii
IMPPFKIPFYSGESGN

SEQ ID NO: 209157 - protein, 16 aa, Borrelia afzelii
MPPFKIPFYSGESGNQ

SEQ ID NO: 209158 - protein, 16 aa, Borrelia afzelii
PPFKIPFYSGESGNQF

SEQ ID NO: 209159 - protein, 16 aa, Borrelia afzelii
PFKIPFYSGESGNQFL

SEQ ID NO: 209160 - protein, 16 aa, Borrelia afzelii
FKIPFYSGESGNQFLG

SEQ ID NO: 209161 - protein, 16 aa, Borrelia afzelii
KIPFYSGESGNQFLGK

SEQ ID NO: 209162 - protein, 16 aa, Borrelia afzelii
IPFYSGESGNQFLGKG

SEQ ID NO: 209163 - protein, 16 aa, Borrelia afzelii
PFYSGESGNQFLGKGL

SEQ ID NO: 209164 - protein, 16 aa, Borrelia afzelii
FYSGESGNQFLGKGLI

SEQ ID NO: 209165 - protein, 16 aa, Borrelia afzelii
YSGESGNQFLGKGLID

SEQ ID NO: 209166 - protein, 16 aa, Borrelia afzelii
SGESGNQFLGKGLIDN

SEQ ID NO: 209167 - protein, 16 aa, Borrelia afzelii
GESGNQFLGKGLIDNI

SEQ ID NO: 209168 - protein, 16 aa, Borrelia afzelii
ESGNQFLGKGLIDNIK

SEQ ID NO: 209169 - protein, 16 aa, Borrelia afzelii
SGNQFLGKGLIDNIKT

SEQ ID NO: 209170 - protein, 16 aa, Borrelia afzelii
GNQFLGKGLIDNIKTM

SEQ ID NO: 209171 - protein, 16 aa, Borrelia afzelii
NQFLGKGLIDNIKTMK

SEQ ID NO: 209172 - protein, 16 aa, Borrelia afzelii
QFLGKGLIDNIKTMKE

SEQ ID NO: 209173 - protein, 16 aa, Borrelia afzelii
FLGKGLIDNIKTMKEI

SEQ ID NO: 209174 - protein, 16 aa, Borrelia afzelii
LGKGLIDNIKTMKEIK

SEQ ID NO: 209175 - protein, 16 aa, Borrelia afzelii
GKGLIDNIKTMKEIKV

SEQ ID NO: 209176 - protein, 16 aa, Borrelia afzelii
KGLIDNIKTMKEIKVS

SEQ ID NO: 209177 - protein, 16 aa, Borrelia afzelii
GLIDNIKTMKEIKVSV

SEQ ID NO: 209178 - protein, 16 aa, Borrelia afzelii
LIDNIKTMKEIKVSVY

SEQ ID NO: 209179 - protein, 16 aa, Borrelia afzelii
IDNIKTMKEIKVSVYS

SEQ ID NO: 209180 - protein, 16 aa, Borrelia afzelii
DNIKTMKEIKVSVYSL

SEQ ID NO: 209181 - protein, 16 aa, Borrelia afzelii
NIKTMKEIKVSVYSLG

SEQ ID NO: 209182 - protein, 16 aa, Borrelia afzelii
IKTMKEIKVSVYSLGY

SEQ ID NO: 209183 - protein, 16 aa, Borrelia afzelii
KTMKEIKVSVYSLGYE

SEQ ID NO: 209184 - protein, 16 aa, Borrelia afzelii
TMKEIKVSVYSLGYEV

SEQ ID NO: 209185 - protein, 16 aa, Borrelia afzelii
MKEIKVSVYSLGYEVD

SEQ ID NO: 209186 - protein, 16 aa, Borrelia afzelii
KEIKVSVYSLGYEVDL

SEQ ID NO: 209187 - protein, 16 aa, Borrelia afzelii
EIKVSVYSLGYEVDLE

SEQ ID NO: 209188 - protein, 16 aa, Borrelia afzelii
IKVSVYSLGYEVDLEV

SEQ ID NO: 209189 - protein, 16 aa, Borrelia afzelii
KVSVYSLGYEVDLEVL

SEQ ID NO: 209190 - protein, 16 aa, Borrelia afzelii
VSVYSLGYEVDLEVLF

SEQ ID NO: 209191 - protein, 16 aa, Borrelia afzelii
SVYSLGYEVDLEVLFE

SEQ ID NO: 209192 - protein, 16 aa, Borrelia afzelii
VYSLGYEVDLEVLFED

SEQ ID NO: 209193 - protein, 16 aa, Borrelia afzelii
YSLGYEVDLEVLFEDM

SEQ ID NO: 209194 - protein, 16 aa, Borrelia afzelii
SLGYEVDLEVLFEDMN

SEQ ID NO: 209195 - protein, 16 aa, Borrelia afzelii
LGYEVDLEVLFEDMNG

SEQ ID NO: 209196 - protein, 16 aa, Borrelia afzelii
GYEVDLEVLFEDMNGM

SEQ ID NO: 209197 - protein, 16 aa, Borrelia afzelii
YEVDLEVLFEDMNGME

SEQ ID NO: 209198 - protein, 16 aa, Borrelia afzelii
EVDLEVLFEDMNGMEY

SEQ ID NO: 209199 - protein, 16 aa, Borrelia afzelii
VDLEVLFEDMNGMEYA

SEQ ID NO: 209200 - protein, 16 aa, Borrelia afzelii
DLEVLFEDMNGMEYAY

SEQ ID NO: 209201 - protein, 16 aa, Borrelia afzelii
LEVLFEDMNGMEYAYS

SEQ ID NO: 209202 - protein, 16 aa, Borrelia afzelii
EVLFEDMNGMEYAYSL

SEQ ID NO: 209203 - protein, 16 aa, Borrelia afzelii
VLFEDMNGMEYAYSLG

SEQ ID NO: 209204 - protein, 16 aa, Borrelia afzelii
LFEDMNGMEYAYSLGT

SEQ ID NO: 209205 - protein, 16 aa, Borrelia afzelii
FEDMNGMEYAYSLGTL

SEQ ID NO: 209206 - protein, 16 aa, Borrelia afzelii
EDMNGMEYAYSLGTLK

SEQ ID NO: 209207 - protein, 16 aa, Borrelia afzelii
DMNGMEYAYSLGTLKF

SEQ ID NO: 209208 - protein, 16 aa, Borrelia afzelii
MNGMEYAYSLGTLKFK

SEQ ID NO: 209209 - protein, 16 aa, Borrelia afzelii
NGMEYAYSLGTLKFKG

SEQ ID NO: 209210 - protein, 16 aa, Borrelia afzelii
GMEYAYSLGTLKFKGW

SEQ ID NO: 209211 - protein, 16 aa, Borrelia afzelii
MEYAYSLGTLKFKGWA

SEQ ID NO: 209212 - protein, 16 aa, Borrelia afzelii
EYAYSLGTLKFKGWAD

SEQ ID NO: 209213 - protein, 16 aa, Borrelia afzelii
YAYSLGTLKFKGWADL

SEQ ID NO: 209214 - protein, 16 aa, Borrelia afzelii
AYSLGTLKFKGWADLI

SEQ ID NO: 209215 - protein, 16 aa, Borrelia afzelii
YSLGTLKFKGWADLIW

SEQ ID NO: 209216 - protein, 16 aa, Borrelia afzelii
SLGTLKFKGWADLIWS

SEQ ID NO: 209217 - protein, 16 aa, Borrelia afzelii
LGTLKFKGWADLIWSN

SEQ ID NO: 209218 - protein, 16 aa, Borrelia afzelii
GTLKFKGWADLIWSNP

SEQ ID NO: 209219 - protein, 16 aa, Borrelia afzelii
TLKFKGWADLIWSNPN

SEQ ID NO: 209220 - protein, 16 aa, Borrelia afzelii
LKFKGWADLIWSNPNY

SEQ ID NO: 209221 - protein, 16 aa, Borrelia afzelii
KFKGWADLIWSNPNYI

SEQ ID NO: 209222 - protein, 16 aa, Borrelia afzelii
FKGWADLIWSNPNYIP

SEQ ID NO: 209223 - protein, 16 aa, Borrelia afzelii
KGWADLIWSNPNYIPN

SEQ ID NO: 209224 - protein, 16 aa, Borrelia afzelii
GWADLIWSNPNYIPNI

SEQ ID NO: 209225 - protein, 16 aa, Borrelia afzelii
WADLIWSNPNYIPNIS

SEQ ID NO: 209226 - protein, 16 aa, Borrelia afzelii
ADLIWSNPNYIPNISA

SEQ ID NO: 209227 - protein, 16 aa, Borrelia afzelii
DLIWSNPNYIPNISAR

SEQ ID NO: 209228 - protein, 16 aa, Borrelia afzelii
LIWSNPNYIPNISARI

SEQ ID NO: 209229 - protein, 16 aa, Borrelia afzelii
IWSNPNYIPNISARII

SEQ ID NO: 209230 - protein, 16 aa, Borrelia afzelii
WSNPNYIPNISARIIK

SEQ ID NO: 209231 - protein, 16 aa, Borrelia afzelii
SNPNYIPNISARIIKD

SEQ ID NO: 209232 - protein, 16 aa, Borrelia afzelii
NPNYIPNISARIIKDD

SEQ ID NO: 209233 - protein, 16 aa, Borrelia afzelii
PNYIPNISARIIKDDV

SEQ ID NO: 209234 - protein, 16 aa, Borrelia afzelii
NYIPNISARIIKDDVP

SEQ ID NO: 209235 - protein, 16 aa, Borrelia afzelii
YIPNISARIIKDDVPN

SEQ ID NO: 209236 - protein, 16 aa, Borrelia afzelii
IPNISARIIKDDVPNY

SEQ ID NO: 209237 - protein, 16 aa, Borrelia afzelii
PNISARIIKDDVPNYP

SEQ ID NO: 209238 - protein, 16 aa, Borrelia afzelii
NISARIIKDDVPNYPL

SEQ ID NO: 209239 - protein, 16 aa, Borrelia afzelii
ISARIIKDDVPNYPLA

SEQ ID NO: 209240 - protein, 16 aa, Borrelia afzelii
SARIIKDDVPNYPLAS

SEQ ID NO: 209241 - protein, 16 aa, Borrelia afzelii
ARIIKDDVPNYPLASS

SEQ ID NO: 209242 - protein, 16 aa, Borrelia afzelii
RIIKDDVPNYPLASSK

SEQ ID NO: 209243 - protein, 16 aa, Borrelia afzelii
IIKDDVPNYPLASSKM

SEQ ID NO: 209244 - protein, 16 aa, Borrelia afzelii
IKDDVPNYPLASSKMR

SEQ ID NO: 209245 - protein, 16 aa, Borrelia afzelii
KDDVPNYPLASSKMRF

SEQ ID NO: 209246 - protein, 16 aa, Borrelia afzelii
DDVPNYPLASSKMRFK

SEQ ID NO: 209247 - protein, 16 aa, Borrelia afzelii
DVPNYPLASSKMRFKA

SEQ ID NO: 209248 - protein, 16 aa, Borrelia afzelii
VPNYPLASSKMRFKAF

SEQ ID NO: 209249 - protein, 16 aa, Borrelia afzelii
PNYPLASSKMRFKAFR

SEQ ID NO: 209250 - protein, 16 aa, Borrelia afzelii
NYPLASSKMRFKAFRV

SEQ ID NO: 209251 - protein, 16 aa, Borrelia afzelii
YPLASSKMRFKAFRVS

SEQ ID NO: 209252 - protein, 16 aa, Borrelia afzelii
PLASSKMRFKAFRVSK

SEQ ID NO: 209253 - protein, 16 aa, Borrelia afzelii
LASSKMRFKAFRVSKS

SEQ ID NO: 209254 - protein, 16 aa, Borrelia afzelii
ASSKMRFKAFRVSKSH

SEQ ID NO: 209255 - protein, 16 aa, Borrelia afzelii
SSKMRFKAFRVSKSHS

SEQ ID NO: 209256 - protein, 16 aa, Borrelia afzelii
SKMRFKAFRVSKSHSS

SEQ ID NO: 209257 - protein, 16 aa, Borrelia afzelii
KMRFKAFRVSKSHSSK

SEQ ID NO: 209258 - protein, 16 aa, Borrelia afzelii
MRFKAFRVSKSHSSKE

SEQ ID NO: 209259 - protein, 16 aa, Borrelia afzelii
RFKAFRVSKSHSSKEQ

SEQ ID NO: 209260 - protein, 16 aa, Borrelia afzelii
FKAFRVSKSHSSKEQN

SEQ ID NO: 209261 - protein, 16 aa, Borrelia afzelii
KAFRVSKSHSSKEQNF

SEQ ID NO: 209262 - protein, 16 aa, Borrelia afzelii
AFRVSKSHSSKEQNFI

SEQ ID NO: 209263 - protein, 16 aa, Borrelia afzelii
FRVSKSHSSKEQNFIF

SEQ ID NO: 209264 - protein, 16 aa, Borrelia afzelii
RVSKSHSSKEQNFIFY

SEQ ID NO: 209265 - protein, 16 aa, Borrelia afzelii
VSKSHSSKEQNFIFYV

SEQ ID NO: 209266 - protein, 16 aa, Borrelia afzelii
SKSHSSKEQNFIFYVK

SEQ ID NO: 209267 - protein, 16 aa, Borrelia afzelii
KSHSSKEQNFIFYVKD

SEQ ID NO: 209268 - protein, 16 aa, Borrelia afzelii
SHSSKEQNFIFYVKDL

SEQ ID NO: 209269 - protein, 16 aa, Borrelia afzelii
HSSKEQNFIFYVKDLR

SEQ ID NO: 209270 - protein, 16 aa, Borrelia afzelii
SSKEQNFIFYVKDLRV

SEQ ID NO: 209271 - protein, 16 aa, Borrelia afzelii
SKEQNFIFYVKDLRVL

SEQ ID NO: 209272 - protein, 16 aa, Borrelia afzelii
KEQNFIFYVKDLRVLY

SEQ ID NO: 209273 - protein, 16 aa, Borrelia afzelii
EQNFIFYVKDLRVLYD

SEQ ID NO: 209274 - protein, 16 aa, Borrelia afzelii
QNFIFYVKDLRVLYDK

SEQ ID NO: 209275 - protein, 16 aa, Borrelia afzelii
NFIFYVKDLRVLYDKL

SEQ ID NO: 209276 - protein, 16 aa, Borrelia afzelii
FIFYVKDLRVLYDKLS

SEQ ID NO: 209277 - protein, 16 aa, Borrelia afzelii
IFYVKDLRVLYDKLSV

SEQ ID NO: 209278 - protein, 16 aa, Borrelia afzelii
FYVKDLRVLYDKLSVS

SEQ ID NO: 209279 - protein, 16 aa, Borrelia afzelii
YVKDLRVLYDKLSVSI

SEQ ID NO: 209280 - protein, 16 aa, Borrelia afzelii
VKDLRVLYDKLSVSID

SEQ ID NO: 209281 - protein, 16 aa, Borrelia afzelii
KDLRVLYDKLSVSIDS

SEQ ID NO: 209282 - protein, 16 aa, Borrelia afzelii
DLRVLYDKLSVSIDSD

SEQ ID NO: 209283 - protein, 16 aa, Borrelia afzelii
LRVLYDKLSVSIDSDI

SEQ ID NO: 209284 - protein, 16 aa, Borrelia afzelii
RVLYDKLSVSIDSDID

SEQ ID NO: 209285 - protein, 16 aa, Borrelia afzelii
VLYDKLSVSIDSDIDS

SEQ ID NO: 209286 - protein, 16 aa, Borrelia afzelii
LYDKLSVSIDSDIDSE

SEQ ID NO: 209287 - protein, 16 aa, Borrelia afzelii
YDKLSVSIDSDIDSES

SEQ ID NO: 209288 - protein, 16 aa, Borrelia afzelii
DKLSVSIDSDIDSESV

SEQ ID NO: 209289 - protein, 16 aa, Borrelia afzelii
KLSVSIDSDIDSESVF

SEQ ID NO: 209290 - protein, 16 aa, Borrelia afzelii
LSVSIDSDIDSESVFK

SEQ ID NO: 209291 - protein, 16 aa, Borrelia afzelii
SVSIDSDIDSESVFKV

SEQ ID NO: 209292 - protein, 16 aa, Borrelia afzelii
VSIDSDIDSESVFKVY

SEQ ID NO: 209293 - protein, 16 aa, Borrelia afzelii
SIDSDIDSESVFKVYE

SEQ ID NO: 209294 - protein, 16 aa, Borrelia afzelii
IDSDIDSESVFKVYET

SEQ ID NO: 209295 - protein, 16 aa, Borrelia afzelii
DSDIDSESVFKVYETS

SEQ ID NO: 209296 - protein, 16 aa, Borrelia afzelii
SDIDSESVFKVYETSG

SEQ ID NO: 209297 - protein, 16 aa, Borrelia afzelii
DIDSESVFKVYETSGA

SEQ ID NO: 209298 - protein, 16 aa, Borrelia afzelii
IDSESVFKVYETSGAE

SEQ ID NO: 209299 - protein, 16 aa, Borrelia afzelii
DSESVFKVYETSGAES

SEQ ID NO: 209300 - protein, 16 aa, Borrelia afzelii
SESVFKVYETSGAESL

SEQ ID NO: 209301 - protein, 16 aa, Borrelia afzelii
ESVFKVYETSGAESLR

SEQ ID NO: 209302 - protein, 16 aa, Borrelia afzelii
SVFKVYETSGAESLRK

SEQ ID NO: 209303 - protein, 16 aa, Borrelia afzelii
VFKVYETSGAESLRKL

SEQ ID NO: 209304 - protein, 16 aa, Borrelia afzelii
FKVYETSGAESLRKLK

SEQ ID NO: 209305 - protein, 16 aa, Borrelia afzelii
KVYETSGAESLRKLKA

SEQ ID NO: 209306 - protein, 16 aa, Borrelia afzelii
VYETSGAESLRKLKAH

SEQ ID NO: 209307 - protein, 16 aa, Borrelia afzelii
YETSGAESLRKLKAHE

SEQ ID NO: 209308 - protein, 16 aa, Borrelia afzelii
ETSGAESLRKLKAHET

SEQ ID NO: 209309 - protein, 16 aa, Borrelia afzelii
TSGAESLRKLKAHETF

SEQ ID NO: 209310 - protein, 16 aa, Borrelia afzelii
SGAESLRKLKAHETFK

SEQ ID NO: 209311 - protein, 16 aa, Borrelia afzelii
GAESLRKLKAHETFKR

SEQ ID NO: 209312 - protein, 16 aa, Borrelia afzelii
AESLRKLKAHETFKRV

SEQ ID NO: 209313 - protein, 16 aa, Borrelia afzelii
ESLRKLKAHETFKRVL

SEQ ID NO: 209314 - protein, 16 aa, Borrelia afzelii
SLRKLKAHETFKRVLK

SEQ ID NO: 209315 - protein, 16 aa, Borrelia afzelii
LRKLKAHETFKRVLKL

SEQ ID NO: 209316 - protein, 16 aa, Borrelia afzelii
RKLKAHETFKRVLKLR

SEQ ID NO: 209317 - protein, 16 aa, Borrelia afzelii
KLKAHETFKRVLKLRE

SEQ ID NO: 209318 - protein, 16 aa, Borrelia afzelii
LKAHETFKRVLKLREK

SEQ ID NO: 209319 - protein, 16 aa, Borrelia afzelii
KAHETFKRVLKLREKI

SEQ ID NO: 209320 - protein, 16 aa, Borrelia afzelii
AHETFKRVLKLREKIS

SEQ ID NO: 209321 - protein, 16 aa, Borrelia afzelii
HETFKRVLKLREKISM

SEQ ID NO: 209322 - protein, 16 aa, Borrelia afzelii
ETFKRVLKLREKISMP

SEQ ID NO: 209323 - protein, 16 aa, Borrelia afzelii
TFKRVLKLREKISMPE

SEQ ID NO: 209324 - protein, 16 aa, Borrelia afzelii
FKRVLKLREKISMPEG

SEQ ID NO: 209325 - protein, 16 aa, Borrelia afzelii
KRVLKLREKISMPEGS

SEQ ID NO: 209326 - protein, 16 aa, Borrelia afzelii
RVLKLREKISMPEGSF

SEQ ID NO: 209327 - protein, 16 aa, Borrelia afzelii
VLKLREKISMPEGSFQ

SEQ ID NO: 209328 - protein, 16 aa, Borrelia afzelii
LKLREKISMPEGSFQN

SEQ ID NO: 209329 - protein, 16 aa, Borrelia afzelii
KLREKISMPEGSFQNF

SEQ ID NO: 209330 - protein, 16 aa, Borrelia afzelii
LREKISMPEGSFQNFI

SEQ ID NO: 209331 - protein, 16 aa, Borrelia afzelii
REKISMPEGSFQNFIE

SEQ ID NO: 209332 - protein, 16 aa, Borrelia afzelii
EKISMPEGSFQNFIEK

SEQ ID NO: 209333 - protein, 16 aa, Borrelia afzelii
KISMPEGSFQNFIEKV

SEQ ID NO: 209334 - protein, 16 aa, Borrelia afzelii
ISMPEGSFQNFIEKVE

SEQ ID NO: 209335 - protein, 16 aa, Borrelia afzelii
SMPEGSFQNFIEKVES

SEQ ID NO: 209336 - protein, 16 aa, Borrelia afzelii
MPEGSFQNFIEKVESD

SEQ ID NO: 209337 - protein, 16 aa, Borrelia afzelii
PEGSFQNFIEKVESDK

SEQ ID NO: 209338 - protein, 16 aa, Borrelia afzelii
EGSFQNFIEKVESDKP

SEQ ID NO: 209339 - protein, 16 aa, Borrelia afzelii
GSFQNFIEKVESDKPE

SEQ ID NO: 209340 - protein, 16 aa, Borrelia afzelii
SFQNFIEKVESDKPEE

SEQ ID NO: 209341 - protein, 16 aa, Borrelia afzelii
FQNFIEKVESDKPEES

SEQ ID NO: 209342 - protein, 16 aa, Borrelia afzelii
QNFIEKVESDKPEESS

SEQ ID NO: 209343 - protein, 16 aa, Borrelia afzelii
NFIEKVESDKPEESSS

SEQ ID NO: 209344 - protein, 16 aa, Borrelia afzelii
FIEKVESDKPEESSSE

SEQ ID NO: 209345 - protein, 16 aa, Borrelia afzelii
IEKVESDKPEESSSEN

SEQ ID NO: 209346 - protein, 8 aa, Borrelia afzelii
MKRKAKSI

SEQ ID NO: 209347 - protein, 8 aa, Borrelia afzelii
KRKAKSIL

SEQ ID NO: 209348 - protein, 8 aa, Borrelia afzelii
RKAKSILF

SEQ ID NO: 209349 - protein, 8 aa, Borrelia afzelii
KAKSILFF

SEQ ID NO: 209350 - protein, 8 aa, Borrelia afzelii
AKSILFFL

SEQ ID NO: 209351 - protein, 8 aa, Borrelia afzelii
KSILFFLL

SEQ ID NO: 209352 - protein, 8 aa, Borrelia afzelii
SILFFLLS

SEQ ID NO: 209353 - protein, 8 aa, Borrelia afzelii
ILFFLLST

SEQ ID NO: 209354 - protein, 8 aa, Borrelia afzelii
LFFLLSTA

SEQ ID NO: 209355 - protein, 8 aa, Borrelia afzelii
FFLLSTAL

SEQ ID NO: 209356 - protein, 8 aa, Borrelia afzelii
FLLSTALF

SEQ ID NO: 209357 - protein, 8 aa, Borrelia afzelii
LLSTALFA

SEQ ID NO: 209358 - protein, 8 aa, Borrelia afzelii
LSTALFAQ

SEQ ID NO: 209359 - protein, 8 aa, Borrelia afzelii
STALFAQE

SEQ ID NO: 209360 - protein, 8 aa, Borrelia afzelii
TALFAQET

SEQ ID NO: 209361 - protein, 8 aa, Borrelia afzelii
ALFAQETD

SEQ ID NO: 209362 - protein, 8 aa, Borrelia afzelii
LFAQETDG

SEQ ID NO: 209363 - protein, 8 aa, Borrelia afzelii
FAQETDGL

SEQ ID NO: 209364 - protein, 8 aa, Borrelia afzelii
AQETDGLT

SEQ ID NO: 209365 - protein, 8 aa, Borrelia afzelii
QETDGLTE

SEQ ID NO: 209366 - protein, 8 aa, Borrelia afzelii
ETDGLTEG

SEQ ID NO: 209367 - protein, 8 aa, Borrelia afzelii
TDGLTEGS

SEQ ID NO: 209368 - protein, 8 aa, Borrelia afzelii
DGLTEGSK

SEQ ID NO: 209369 - protein, 8 aa, Borrelia afzelii
GLTEGSKR

SEQ ID NO: 209370 - protein, 8 aa, Borrelia afzelii
LTEGSKRA

SEQ ID NO: 209371 - protein, 8 aa, Borrelia afzelii
TEGSKRAE

SEQ ID NO: 209372 - protein, 8 aa, Borrelia afzelii
EGSKRAEP

SEQ ID NO: 209373 - protein, 8 aa, Borrelia afzelii
GSKRAEPG

SEQ ID NO: 209374 - protein, 8 aa, Borrelia afzelii
SKRAEPGE

SEQ ID NO: 209375 - protein, 8 aa, Borrelia afzelii
KRAEPGEL

SEQ ID NO: 209376 - protein, 8 aa, Borrelia afzelii
RAEPGELV

SEQ ID NO: 209377 - protein, 8 aa, Borrelia afzelii
AEPGELVL

SEQ ID NO: 209378 - protein, 8 aa, Borrelia afzelii
EPGELVLD

SEQ ID NO: 209379 - protein, 8 aa, Borrelia afzelii
PGELVLDF

SEQ ID NO: 209380 - protein, 8 aa, Borrelia afzelii
GELVLDFA

SEQ ID NO: 209381 - protein, 8 aa, Borrelia afzelii
ELVLDFAE

SEQ ID NO: 209382 - protein, 8 aa, Borrelia afzelii
LVLDFAEL

SEQ ID NO: 209383 - protein, 8 aa, Borrelia afzelii
VLDFAELA

SEQ ID NO: 209384 - protein, 8 aa, Borrelia afzelii
LDFAELAR

SEQ ID NO: 209385 - protein, 8 aa, Borrelia afzelii
DFAELARD

SEQ ID NO: 209386 - protein, 8 aa, Borrelia afzelii
FAELARDP

SEQ ID NO: 209387 - protein, 8 aa, Borrelia afzelii
AELARDPS

SEQ ID NO: 209388 - protein, 8 aa, Borrelia afzelii
ELARDPSS

SEQ ID NO: 209389 - protein, 8 aa, Borrelia afzelii
LARDPSST

SEQ ID NO: 209390 - protein, 8 aa, Borrelia afzelii
ARDPSSTK

SEQ ID NO: 209391 - protein, 8 aa, Borrelia afzelii
RDPSSTKL

SEQ ID NO: 209392 - protein, 8 aa, Borrelia afzelii
DPSSTKLD

SEQ ID NO: 209393 - protein, 8 aa, Borrelia afzelii
PSSTKLDL

SEQ ID NO: 209394 - protein, 8 aa, Borrelia afzelii
SSTKLDLT

SEQ ID NO: 209395 - protein, 8 aa, Borrelia afzelii
STKLDLTN

SEQ ID NO: 209396 - protein, 8 aa, Borrelia afzelii
TKLDLTNY

SEQ ID NO: 209397 - protein, 8 aa, Borrelia afzelii
KLDLTNYV

SEQ ID NO: 209398 - protein, 8 aa, Borrelia afzelii
LDLTNYVD

SEQ ID NO: 209399 - protein, 8 aa, Borrelia afzelii
DLTNYVDY

SEQ ID NO: 209400 - protein, 8 aa, Borrelia afzelii
LTNYVDYV

SEQ ID NO: 209401 - protein, 8 aa, Borrelia afzelii
TNYVDYVY

SEQ ID NO: 209402 - protein, 8 aa, Borrelia afzelii
NYVDYVYS

SEQ ID NO: 209403 - protein, 8 aa, Borrelia afzelii
YVDYVYSG

SEQ ID NO: 209404 - protein, 8 aa, Borrelia afzelii
VDYVYSGA

SEQ ID NO: 209405 - protein, 8 aa, Borrelia afzelii
DYVYSGAS

SEQ ID NO: 209406 - protein, 8 aa, Borrelia afzelii
YVYSGASG

SEQ ID NO: 209407 - protein, 8 aa, Borrelia afzelii
VYSGASGI

SEQ ID NO: 209408 - protein, 8 aa, Borrelia afzelii
YSGASGIV

SEQ ID NO: 209409 - protein, 8 aa, Borrelia afzelii
SGASGIVK

SEQ ID NO: 209410 - protein, 8 aa, Borrelia afzelii
GASGIVKP

SEQ ID NO: 209411 - protein, 8 aa, Borrelia afzelii
ASGIVKPE

SEQ ID NO: 209412 - protein, 8 aa, Borrelia afzelii
SGIVKPED

SEQ ID NO: 209413 - protein, 8 aa, Borrelia afzelii
GIVKPEDM

SEQ ID NO: 209414 - protein, 8 aa, Borrelia afzelii
IVKPEDMV

SEQ ID NO: 209415 - protein, 8 aa, Borrelia afzelii
VKPEDMVV

SEQ ID NO: 209416 - protein, 8 aa, Borrelia afzelii
KPEDMVVD

SEQ ID NO: 209417 - protein, 8 aa, Borrelia afzelii
PEDMVVDL

SEQ ID NO: 209418 - protein, 8 aa, Borrelia afzelii
EDMVVDLG

SEQ ID NO: 209419 - protein, 8 aa, Borrelia afzelii
DMVVDLGI

SEQ ID NO: 209420 - protein, 8 aa, Borrelia afzelii
MVVDLGIS

SEQ ID NO: 209421 - protein, 8 aa, Borrelia afzelii
VVDLGISN

SEQ ID NO: 209422 - protein, 8 aa, Borrelia afzelii
VDLGISNW

SEQ ID NO: 209423 - protein, 8 aa, Borrelia afzelii
DLGISNWS

SEQ ID NO: 209424 - protein, 8 aa, Borrelia afzelii
LGISNWSV

SEQ ID NO: 209425 - protein, 8 aa, Borrelia afzelii
GISNWSVL

SEQ ID NO: 209426 - protein, 8 aa, Borrelia afzelii
ISNWSVLL

SEQ ID NO: 209427 - protein, 8 aa, Borrelia afzelii
SNWSVLLT

SEQ ID NO: 209428 - protein, 8 aa, Borrelia afzelii
NWSVLLTP

SEQ ID NO: 209429 - protein, 8 aa, Borrelia afzelii
WSVLLTPS

SEQ ID NO: 209430 - protein, 8 aa, Borrelia afzelii
SVLLTPSA

SEQ ID NO: 209431 - protein, 8 aa, Borrelia afzelii
VLLTPSAR

SEQ ID NO: 209432 - protein, 8 aa, Borrelia afzelii
LLTPSARL

SEQ ID NO: 209433 - protein, 8 aa, Borrelia afzelii
LTPSARLQ

SEQ ID NO: 209434 - protein, 8 aa, Borrelia afzelii
TPSARLQA

SEQ ID NO: 209435 - protein, 8 aa, Borrelia afzelii
PSARLQAY

SEQ ID NO: 209436 - protein, 8 aa, Borrelia afzelii
SARLQAYV

SEQ ID NO: 209437 - protein, 8 aa, Borrelia afzelii
ARLQAYVK

SEQ ID NO: 209438 - protein, 8 aa, Borrelia afzelii
RLQAYVKN

SEQ ID NO: 209439 - protein, 8 aa, Borrelia afzelii
LQAYVKNS

SEQ ID NO: 209440 - protein, 8 aa, Borrelia afzelii
QAYVKNSV

SEQ ID NO: 209441 - protein, 8 aa, Borrelia afzelii
AYVKNSVV

SEQ ID NO: 209442 - protein, 8 aa, Borrelia afzelii
YVKNSVVA

SEQ ID NO: 209443 - protein, 8 aa, Borrelia afzelii
VKNSVVAP

SEQ ID NO: 209444 - protein, 8 aa, Borrelia afzelii
KNSVVAPA

SEQ ID NO: 209445 - protein, 8 aa, Borrelia afzelii
NSVVAPAL

SEQ ID NO: 209446 - protein, 8 aa, Borrelia afzelii
SVVAPALV

SEQ ID NO: 209447 - protein, 8 aa, Borrelia afzelii
VVAPALVK

SEQ ID NO: 209448 - protein, 8 aa, Borrelia afzelii
VAPALVKS

SEQ ID NO: 209449 - protein, 8 aa, Borrelia afzelii
APALVKSE

SEQ ID NO: 209450 - protein, 8 aa, Borrelia afzelii
PALVKSES

SEQ ID NO: 209451 - protein, 8 aa, Borrelia afzelii
ALVKSESK

SEQ ID NO: 209452 - protein, 8 aa, Borrelia afzelii
LVKSESKR

SEQ ID NO: 209453 - protein, 8 aa, Borrelia afzelii
VKSESKRY

SEQ ID NO: 209454 - protein, 8 aa, Borrelia afzelii
KSESKRYA

SEQ ID NO: 209455 - protein, 8 aa, Borrelia afzelii
SESKRYAG

SEQ ID NO: 209456 - protein, 8 aa, Borrelia afzelii
ESKRYAGD

SEQ ID NO: 209457 - protein, 8 aa, Borrelia afzelii
SKRYAGDT

SEQ ID NO: 209458 - protein, 8 aa, Borrelia afzelii
KRYAGDTI

SEQ ID NO: 209459 - protein, 8 aa, Borrelia afzelii
RYAGDTIL

SEQ ID NO: 209460 - protein, 8 aa, Borrelia afzelii
YAGDTILG

SEQ ID NO: 209461 - protein, 8 aa, Borrelia afzelii
AGDTILGV

SEQ ID NO: 209462 - protein, 8 aa, Borrelia afzelii
GDTILGVR

SEQ ID NO: 209463 - protein, 8 aa, Borrelia afzelii
DTILGVRV

SEQ ID NO: 209464 - protein, 8 aa, Borrelia afzelii
TILGVRVL

SEQ ID NO: 209465 - protein, 8 aa, Borrelia afzelii
ILGVRVLF

SEQ ID NO: 209466 - protein, 8 aa, Borrelia afzelii
LGVRVLFP

SEQ ID NO: 209467 - protein, 8 aa, Borrelia afzelii
GVRVLFPS

SEQ ID NO: 209468 - protein, 8 aa, Borrelia afzelii
VRVLFPSY

SEQ ID NO: 209469 - protein, 8 aa, Borrelia afzelii
RVLFPSYS

SEQ ID NO: 209470 - protein, 8 aa, Borrelia afzelii
VLFPSYSQ

SEQ ID NO: 209471 - protein, 8 aa, Borrelia afzelii
LFPSYSQS

SEQ ID NO: 209472 - protein, 8 aa, Borrelia afzelii
FPSYSQSS

SEQ ID NO: 209473 - protein, 8 aa, Borrelia afzelii
PSYSQSSA

SEQ ID NO: 209474 - protein, 8 aa, Borrelia afzelii
SYSQSSAM

SEQ ID NO: 209475 - protein, 8 aa, Borrelia afzelii
YSQSSAMI

SEQ ID NO: 209476 - protein, 8 aa, Borrelia afzelii
SQSSAMIM

SEQ ID NO: 209477 - protein, 8 aa, Borrelia afzelii
QSSAMIMP

SEQ ID NO: 209478 - protein, 8 aa, Borrelia afzelii
SSAMIMPP

SEQ ID NO: 209479 - protein, 8 aa, Borrelia afzelii
SAMIMPPF

SEQ ID NO: 209480 - protein, 8 aa, Borrelia afzelii
AMIMPPFK

SEQ ID NO: 209481 - protein, 8 aa, Borrelia afzelii
MIMPPFKI

SEQ ID NO: 209482 - protein, 8 aa, Borrelia afzelii
IMPPFKIP

SEQ ID NO: 209483 - protein, 8 aa, Borrelia afzelii
MPPFKIPF

SEQ ID NO: 209484 - protein, 8 aa, Borrelia afzelii
PPFKIPFY

SEQ ID NO: 209485 - protein, 8 aa, Borrelia afzelii
PFKIPFYS

SEQ ID NO: 209486 - protein, 8 aa, Borrelia afzelii
FKIPFYSG

SEQ ID NO: 209487 - protein, 8 aa, Borrelia afzelii
KIPFYSGE

SEQ ID NO: 209488 - protein, 8 aa, Borrelia afzelii
IPFYSGES

SEQ ID NO: 209489 - protein, 8 aa, Borrelia afzelii
PFYSGESG

SEQ ID NO: 209490 - protein, 8 aa, Borrelia afzelii
FYSGESGN

SEQ ID NO: 209491 - protein, 8 aa, Borrelia afzelii
YSGESGNQ

SEQ ID NO: 209492 - protein, 8 aa, Borrelia afzelii
SGESGNQF

SEQ ID NO: 209493 - protein, 8 aa, Borrelia afzelii
GESGNQFL

SEQ ID NO: 209494 - protein, 8 aa, Borrelia afzelii
ESGNQFLG

SEQ ID NO: 209495 - protein, 8 aa, Borrelia afzelii
SGNQFLGK

SEQ ID NO: 209496 - protein, 8 aa, Borrelia afzelii
GNQFLGKG

SEQ ID NO: 209497 - protein, 8 aa, Borrelia afzelii
NQFLGKGL

SEQ ID NO: 209498 - protein, 8 aa, Borrelia afzelii
QFLGKGLI

SEQ ID NO: 209499 - protein, 8 aa, Borrelia afzelii
FLGKGLID

SEQ ID NO: 209500 - protein, 8 aa, Borrelia afzelii
LGKGLIDN

SEQ ID NO: 209501 - protein, 8 aa, Borrelia afzelii
GKGLIDNI

SEQ ID NO: 209502 - protein, 8 aa, Borrelia afzelii
KGLIDNIK

SEQ ID NO: 209503 - protein, 8 aa, Borrelia afzelii
GLIDNIKT

SEQ ID NO: 209504 - protein, 8 aa, Borrelia afzelii
LIDNIKTM

SEQ ID NO: 209505 - protein, 8 aa, Borrelia afzelii
IDNIKTMK

SEQ ID NO: 209506 - protein, 8 aa, Borrelia afzelii
DNIKTMKE

SEQ ID NO: 209507 - protein, 8 aa, Borrelia afzelii
NIKTMKEI

SEQ ID NO: 209508 - protein, 8 aa, Borrelia afzelii
IKTMKEIK

SEQ ID NO: 209509 - protein, 8 aa, Borrelia afzelii
KTMKEIKV

SEQ ID NO: 209510 - protein, 8 aa, Borrelia afzelii
TMKEIKVS

SEQ ID NO: 209511 - protein, 8 aa, Borrelia afzelii
MKEIKVSV

SEQ ID NO: 209512 - protein, 8 aa, Borrelia afzelii
KEIKVSVY

SEQ ID NO: 209513 - protein, 8 aa, Borrelia afzelii
EIKVSVYS

SEQ ID NO: 209514 - protein, 8 aa, Borrelia afzelii
IKVSVYSL

SEQ ID NO: 209515 - protein, 8 aa, Borrelia afzelii
KVSVYSLG

SEQ ID NO: 209516 - protein, 8 aa, Borrelia afzelii
VSVYSLGY

SEQ ID NO: 209517 - protein, 8 aa, Borrelia afzelii
SVYSLGYE

SEQ ID NO: 209518 - protein, 8 aa, Borrelia afzelii
VYSLGYEV

SEQ ID NO: 209519 - protein, 8 aa, Borrelia afzelii
YSLGYEVD

SEQ ID NO: 209520 - protein, 8 aa, Borrelia afzelii
SLGYEVDL

SEQ ID NO: 209521 - protein, 8 aa, Borrelia afzelii
LGYEVDLE

SEQ ID NO: 209522 - protein, 8 aa, Borrelia afzelii
GYEVDLEV

SEQ ID NO: 209523 - protein, 8 aa, Borrelia afzelii
YEVDLEVL

SEQ ID NO: 209524 - protein, 8 aa, Borrelia afzelii
EVDLEVLF

SEQ ID NO: 209525 - protein, 8 aa, Borrelia afzelii
VDLEVLFE

SEQ ID NO: 209526 - protein, 8 aa, Borrelia afzelii
DLEVLFED

SEQ ID NO: 209527 - protein, 8 aa, Borrelia afzelii
LEVLFEDM

SEQ ID NO: 209528 - protein, 8 aa, Borrelia afzelii
EVLFEDMN

SEQ ID NO: 209529 - protein, 8 aa, Borrelia afzelii
VLFEDMNG

SEQ ID NO: 209530 - protein, 8 aa, Borrelia afzelii
LFEDMNGM

SEQ ID NO: 209531 - protein, 8 aa, Borrelia afzelii
FEDMNGME

SEQ ID NO: 209532 - protein, 8 aa, Borrelia afzelii
EDMNGMEY

SEQ ID NO: 209533 - protein, 8 aa, Borrelia afzelii
DMNGMEYA

SEQ ID NO: 209534 - protein, 8 aa, Borrelia afzelii
MNGMEYAY

SEQ ID NO: 209535 - protein, 8 aa, Borrelia afzelii
NGMEYAYS

SEQ ID NO: 209536 - protein, 8 aa, Borrelia afzelii
GMEYAYSL

SEQ ID NO: 209537 - protein, 8 aa, Borrelia afzelii
MEYAYSLG

SEQ ID NO: 209538 - protein, 8 aa, Borrelia afzelii
EYAYSLGT

SEQ ID NO: 209539 - protein, 8 aa, Borrelia afzelii
YAYSLGTL

SEQ ID NO: 209540 - protein, 8 aa, Borrelia afzelii
AYSLGTLK

SEQ ID NO: 209541 - protein, 8 aa, Borrelia afzelii
YSLGTLKF

SEQ ID NO: 209542 - protein, 8 aa, Borrelia afzelii
SLGTLKFK

SEQ ID NO: 209543 - protein, 8 aa, Borrelia afzelii
LGTLKFKG

SEQ ID NO: 209544 - protein, 8 aa, Borrelia afzelii
GTLKFKGW

SEQ ID NO: 209545 - protein, 8 aa, Borrelia afzelii
TLKFKGWA

SEQ ID NO: 209546 - protein, 8 aa, Borrelia afzelii
LKFKGWAD

SEQ ID NO: 209547 - protein, 8 aa, Borrelia afzelii
KFKGWADL

SEQ ID NO: 209548 - protein, 8 aa, Borrelia afzelii
FKGWADLI

SEQ ID NO: 209549 - protein, 8 aa, Borrelia afzelii
KGWADLIW

SEQ ID NO: 209550 - protein, 8 aa, Borrelia afzelii
GWADLIWS

SEQ ID NO: 209551 - protein, 8 aa, Borrelia afzelii
WADLIWSN

SEQ ID NO: 209552 - protein, 8 aa, Borrelia afzelii
ADLIWSNP

SEQ ID NO: 209553 - protein, 8 aa, Borrelia afzelii
DLIWSNPN

SEQ ID NO: 209554 - protein, 8 aa, Borrelia afzelii
LIWSNPNY

SEQ ID NO: 209555 - protein, 8 aa, Borrelia afzelii
IWSNPNYI

SEQ ID NO: 209556 - protein, 8 aa, Borrelia afzelii
WSNPNYIP

SEQ ID NO: 209557 - protein, 8 aa, Borrelia afzelii
SNPNYIPN

SEQ ID NO: 209558 - protein, 8 aa, Borrelia afzelii
NPNYIPNI

SEQ ID NO: 209559 - protein, 8 aa, Borrelia afzelii
PNYIPNIS

SEQ ID NO: 209560 - protein, 8 aa, Borrelia afzelii
NYIPNISA

SEQ ID NO: 209561 - protein, 8 aa, Borrelia afzelii
YIPNISAR

SEQ ID NO: 209562 - protein, 8 aa, Borrelia afzelii
IPNISARI

SEQ ID NO: 209563 - protein, 8 aa, Borrelia afzelii
PNISARII

SEQ ID NO: 209564 - protein, 8 aa, Borrelia afzelii
NISARIIK

SEQ ID NO: 209565 - protein, 8 aa, Borrelia afzelii
ISARIIKD

SEQ ID NO: 209566 - protein, 8 aa, Borrelia afzelii
SARIIKDD

SEQ ID NO: 209567 - protein, 8 aa, Borrelia afzelii
ARIIKDDV

SEQ ID NO: 209568 - protein, 8 aa, Borrelia afzelii
RIIKDDVP

SEQ ID NO: 209569 - protein, 8 aa, Borrelia afzelii
IIKDDVPN

SEQ ID NO: 209570 - protein, 8 aa, Borrelia afzelii
IKDDVPNY

SEQ ID NO: 209571 - protein, 8 aa, Borrelia afzelii
KDDVPNYP

SEQ ID NO: 209572 - protein, 8 aa, Borrelia afzelii
DDVPNYPL

SEQ ID NO: 209573 - protein, 8 aa, Borrelia afzelii
DVPNYPLA

SEQ ID NO: 209574 - protein, 8 aa, Borrelia afzelii
VPNYPLAS

SEQ ID NO: 209575 - protein, 8 aa, Borrelia afzelii
PNYPLASS

SEQ ID NO: 209576 - protein, 8 aa, Borrelia afzelii
NYPLASSK

SEQ ID NO: 209577 - protein, 8 aa, Borrelia afzelii
YPLASSKM

SEQ ID NO: 209578 - protein, 8 aa, Borrelia afzelii
PLASSKMR

SEQ ID NO: 209579 - protein, 8 aa, Borrelia afzelii
LASSKMRF

SEQ ID NO: 209580 - protein, 8 aa, Borrelia afzelii
ASSKMRFK

SEQ ID NO: 209581 - protein, 8 aa, Borrelia afzelii
SSKMRFKA

SEQ ID NO: 209582 - protein, 8 aa, Borrelia afzelii
SKMRFKAF

SEQ ID NO: 209583 - protein, 8 aa, Borrelia afzelii
KMRFKAFR

SEQ ID NO: 209584 - protein, 8 aa, Borrelia afzelii
MRFKAFRV

SEQ ID NO: 209585 - protein, 8 aa, Borrelia afzelii
RFKAFRVS

SEQ ID NO: 209586 - protein, 8 aa, Borrelia afzelii
FKAFRVSK

SEQ ID NO: 209587 - protein, 8 aa, Borrelia afzelii
KAFRVSKS

SEQ ID NO: 209588 - protein, 8 aa, Borrelia afzelii
AFRVSKSH

SEQ ID NO: 209589 - protein, 8 aa, Borrelia afzelii
FRVSKSHS

SEQ ID NO: 209590 - protein, 8 aa, Borrelia afzelii
RVSKSHSS

SEQ ID NO: 209591 - protein, 8 aa, Borrelia afzelii
VSKSHSSK

SEQ ID NO: 209592 - protein, 8 aa, Borrelia afzelii
SKSHSSKE

SEQ ID NO: 209593 - protein, 8 aa, Borrelia afzelii
KSHSSKEQ

SEQ ID NO: 209594 - protein, 8 aa, Borrelia afzelii
SHSSKEQN

SEQ ID NO: 209595 - protein, 8 aa, Borrelia afzelii
HSSKEQNF

SEQ ID NO: 209596 - protein, 8 aa, Borrelia afzelii
SSKEQNFI

SEQ ID NO: 209597 - protein, 8 aa, Borrelia afzelii
SKEQNFIF

SEQ ID NO: 209598 - protein, 8 aa, Borrelia afzelii
KEQNFIFY

SEQ ID NO: 209599 - protein, 8 aa, Borrelia afzelii
EQNFIFYV

SEQ ID NO: 209600 - protein, 8 aa, Borrelia afzelii
QNFIFYVK

SEQ ID NO: 209601 - protein, 8 aa, Borrelia afzelii
NFIFYVKD

SEQ ID NO: 209602 - protein, 8 aa, Borrelia afzelii
FIFYVKDL

SEQ ID NO: 209603 - protein, 8 aa, Borrelia afzelii
IFYVKDLR

SEQ ID NO: 209604 - protein, 8 aa, Borrelia afzelii
FYVKDLRV

SEQ ID NO: 209605 - protein, 8 aa, Borrelia afzelii
YVKDLRVL

SEQ ID NO: 209606 - protein, 8 aa, Borrelia afzelii
VKDLRVLY

SEQ ID NO: 209607 - protein, 8 aa, Borrelia afzelii
KDLRVLYD

SEQ ID NO: 209608 - protein, 8 aa, Borrelia afzelii
DLRVLYDK

SEQ ID NO: 209609 - protein, 8 aa, Borrelia afzelii
LRVLYDKL

SEQ ID NO: 209610 - protein, 8 aa, Borrelia afzelii
RVLYDKLS

SEQ ID NO: 209611 - protein, 8 aa, Borrelia afzelii
VLYDKLSV

SEQ ID NO: 209612 - protein, 8 aa, Borrelia afzelii
LYDKLSVS

SEQ ID NO: 209613 - protein, 8 aa, Borrelia afzelii
YDKLSVSI

SEQ ID NO: 209614 - protein, 8 aa, Borrelia afzelii
DKLSVSID

SEQ ID NO: 209615 - protein, 8 aa, Borrelia afzelii
KLSVSIDS

SEQ ID NO: 209616 - protein, 8 aa, Borrelia afzelii
LSVSIDSD

SEQ ID NO: 209617 - protein, 8 aa, Borrelia afzelii
SVSIDSDI

SEQ ID NO: 209618 - protein, 8 aa, Borrelia afzelii
VSIDSDID

SEQ ID NO: 209619 - protein, 8 aa, Borrelia afzelii
SIDSDIDS

SEQ ID NO: 209620 - protein, 8 aa, Borrelia afzelii
IDSDIDSE

SEQ ID NO: 209621 - protein, 8 aa, Borrelia afzelii
DSDIDSES

SEQ ID NO: 209622 - protein, 8 aa, Borrelia afzelii
SDIDSESV

SEQ ID NO: 209623 - protein, 8 aa, Borrelia afzelii
DIDSESVF

SEQ ID NO: 209624 - protein, 8 aa, Borrelia afzelii
IDSESVFK

SEQ ID NO: 209625 - protein, 8 aa, Borrelia afzelii
DSESVFKV

SEQ ID NO: 209626 - protein, 8 aa, Borrelia afzelii
SESVFKVY

SEQ ID NO: 209627 - protein, 8 aa, Borrelia afzelii
ESVFKVYE

SEQ ID NO: 209628 - protein, 8 aa, Borrelia afzelii
SVFKVYET

SEQ ID NO: 209629 - protein, 8 aa, Borrelia afzelii
VFKVYETS

SEQ ID NO: 209630 - protein, 8 aa, Borrelia afzelii
FKVYETSG

SEQ ID NO: 209631 - protein, 8 aa, Borrelia afzelii
KVYETSGA

SEQ ID NO: 209632 - protein, 8 aa, Borrelia afzelii
VYETSGAE

SEQ ID NO: 209633 - protein, 8 aa, Borrelia afzelii
YETSGAES

SEQ ID NO: 209634 - protein, 8 aa, Borrelia afzelii
ETSGAESL

SEQ ID NO: 209635 - protein, 8 aa, Borrelia afzelii
TSGAESLR

SEQ ID NO: 209636 - protein, 8 aa, Borrelia afzelii
SGAESLRK

SEQ ID NO: 209637 - protein, 8 aa, Borrelia afzelii
GAESLRKL

SEQ ID NO: 209638 - protein, 8 aa, Borrelia afzelii
AESLRKLK

SEQ ID NO: 209639 - protein, 8 aa, Borrelia afzelii
ESLRKLKA

SEQ ID NO: 209640 - protein, 8 aa, Borrelia afzelii
SLRKLKAH

SEQ ID NO: 209641 - protein, 8 aa, Borrelia afzelii
LRKLKAHE

SEQ ID NO: 209642 - protein, 8 aa, Borrelia afzelii
RKLKAHET

SEQ ID NO: 209643 - protein, 8 aa, Borrelia afzelii
KLKAHETF

SEQ ID NO: 209644 - protein, 8 aa, Borrelia afzelii
LKAHETFK

SEQ ID NO: 209645 - protein, 8 aa, Borrelia afzelii
KAHETFKR

SEQ ID NO: 209646 - protein, 8 aa, Borrelia afzelii
AHETFKRV

SEQ ID NO: 209647 - protein, 8 aa, Borrelia afzelii
HETFKRVL

SEQ ID NO: 209648 - protein, 8 aa, Borrelia afzelii
ETFKRVLK

SEQ ID NO: 209649 - protein, 8 aa, Borrelia afzelii
TFKRVLKL

SEQ ID NO: 209650 - protein, 8 aa, Borrelia afzelii
FKRVLKLR

SEQ ID NO: 209651 - protein, 8 aa, Borrelia afzelii
KRVLKLRE

SEQ ID NO: 209652 - protein, 8 aa, Borrelia afzelii
RVLKLREK

SEQ ID NO: 209653 - protein, 8 aa, Borrelia afzelii
VLKLREKI

SEQ ID NO: 209654 - protein, 8 aa, Borrelia afzelii
LKLREKIS

SEQ ID NO: 209655 - protein, 8 aa, Borrelia afzelii
KLREKISM

SEQ ID NO: 209656 - protein, 8 aa, Borrelia afzelii
LREKISMP

SEQ ID NO: 209657 - protein, 8 aa, Borrelia afzelii
REKISMPE

SEQ ID NO: 209658 - protein, 8 aa, Borrelia afzelii
EKISMPEG

SEQ ID NO: 209659 - protein, 8 aa, Borrelia afzelii
KISMPEGS

SEQ ID NO: 209660 - protein, 8 aa, Borrelia afzelii
ISMPEGSF

SEQ ID NO: 209661 - protein, 8 aa, Borrelia afzelii
SMPEGSFQ

SEQ ID NO: 209662 - protein, 8 aa, Borrelia afzelii
MPEGSFQN

SEQ ID NO: 209663 - protein, 8 aa, Borrelia afzelii
PEGSFQNF

SEQ ID NO: 209664 - protein, 8 aa, Borrelia afzelii
EGSFQNFI

SEQ ID NO: 209665 - protein, 8 aa, Borrelia afzelii
GSFQNFIE

SEQ ID NO: 209666 - protein, 8 aa, Borrelia afzelii
SFQNFIEK

SEQ ID NO: 209667 - protein, 8 aa, Borrelia afzelii
FQNFIEKV

SEQ ID NO: 209668 - protein, 8 aa, Borrelia afzelii
QNFIEKVE

SEQ ID NO: 209669 - protein, 8 aa, Borrelia afzelii
NFIEKVES

SEQ ID NO: 209670 - protein, 8 aa, Borrelia afzelii
FIEKVESD

SEQ ID NO: 209671 - protein, 8 aa, Borrelia afzelii
IEKVESDK

SEQ ID NO: 209672 - protein, 8 aa, Borrelia afzelii
EKVESDKP

SEQ ID NO: 209673 - protein, 8 aa, Borrelia afzelii
KVESDKPE

SEQ ID NO: 209674 - protein, 8 aa, Borrelia afzelii
VESDKPEE

SEQ ID NO: 209675 - protein, 8 aa, Borrelia afzelii
ESDKPEES

SEQ ID NO: 209676 - protein, 8 aa, Borrelia afzelii
SDKPEESS

SEQ ID NO: 209677 - protein, 8 aa, Borrelia afzelii
DKPEESSS

SEQ ID NO: 209678 - protein, 8 aa, Borrelia afzelii
KPEESSSE

SEQ ID NO: 209679 - protein, 8 aa, Borrelia afzelii
PEESSSEN

SEQ ID NO: 209680 - protein, 9 aa, Borrelia afzelii
MKRKAKSIL

SEQ ID NO: 209681 - protein, 9 aa, Borrelia afzelii
KRKAKSILF

SEQ ID NO: 209682 - protein, 9 aa, Borrelia afzelii
RKAKSILFF

SEQ ID NO: 209683 - protein, 9 aa, Borrelia afzelii
KAKSILFFL

SEQ ID NO: 209684 - protein, 9 aa, Borrelia afzelii
AKSILFFLL

SEQ ID NO: 209685 - protein, 9 aa, Borrelia afzelii
KSILFFLLS

SEQ ID NO: 209686 - protein, 9 aa, Borrelia afzelii
SILFFLLST

SEQ ID NO: 209687 - protein, 9 aa, Borrelia afzelii
ILFFLLSTA

SEQ ID NO: 209688 - protein, 9 aa, Borrelia afzelii
LFFLLSTAL

SEQ ID NO: 209689 - protein, 9 aa, Borrelia afzelii
FFLLSTALF

SEQ ID NO: 209690 - protein, 9 aa, Borrelia afzelii
FLLSTALFA

SEQ ID NO: 209691 - protein, 9 aa, Borrelia afzelii
LLSTALFAQ

SEQ ID NO: 209692 - protein, 9 aa, Borrelia afzelii
LSTALFAQE

SEQ ID NO: 209693 - protein, 9 aa, Borrelia afzelii
STALFAQET

SEQ ID NO: 209694 - protein, 9 aa, Borrelia afzelii
TALFAQETD

SEQ ID NO: 209695 - protein, 9 aa, Borrelia afzelii
ALFAQETDG

SEQ ID NO: 209696 - protein, 9 aa, Borrelia afzelii
LFAQETDGL

SEQ ID NO: 209697 - protein, 9 aa, Borrelia afzelii
FAQETDGLT

SEQ ID NO: 209698 - protein, 9 aa, Borrelia afzelii
AQETDGLTE

SEQ ID NO: 209699 - protein, 9 aa, Borrelia afzelii
QETDGLTEG

SEQ ID NO: 209700 - protein, 9 aa, Borrelia afzelii
ETDGLTEGS

SEQ ID NO: 209701 - protein, 9 aa, Borrelia afzelii
TDGLTEGSK

SEQ ID NO: 209702 - protein, 9 aa, Borrelia afzelii
DGLTEGSKR

SEQ ID NO: 209703 - protein, 9 aa, Borrelia afzelii
GLTEGSKRA

SEQ ID NO: 209704 - protein, 9 aa, Borrelia afzelii
LTEGSKRAE

SEQ ID NO: 209705 - protein, 9 aa, Borrelia afzelii
TEGSKRAEP

SEQ ID NO: 209706 - protein, 9 aa, Borrelia afzelii
EGSKRAEPG

SEQ ID NO: 209707 - protein, 9 aa, Borrelia afzelii
GSKRAEPGE

SEQ ID NO: 209708 - protein, 9 aa, Borrelia afzelii
SKRAEPGEL

SEQ ID NO: 209709 - protein, 9 aa, Borrelia afzelii
KRAEPGELV

SEQ ID NO: 209710 - protein, 9 aa, Borrelia afzelii
RAEPGELVL

SEQ ID NO: 209711 - protein, 9 aa, Borrelia afzelii
AEPGELVLD

SEQ ID NO: 209712 - protein, 9 aa, Borrelia afzelii
EPGELVLDF

SEQ ID NO: 209713 - protein, 9 aa, Borrelia afzelii
PGELVLDFA

SEQ ID NO: 209714 - protein, 9 aa, Borrelia afzelii
GELVLDFAE

SEQ ID NO: 209715 - protein, 9 aa, Borrelia afzelii
ELVLDFAEL

SEQ ID NO: 209716 - protein, 9 aa, Borrelia afzelii
LVLDFAELA

SEQ ID NO: 209717 - protein, 9 aa, Borrelia afzelii
VLDFAELAR

SEQ ID NO: 209718 - protein, 9 aa, Borrelia afzelii
LDFAELARD

SEQ ID NO: 209719 - protein, 9 aa, Borrelia afzelii
DFAELARDP

SEQ ID NO: 209720 - protein, 9 aa, Borrelia afzelii
FAELARDPS

SEQ ID NO: 209721 - protein, 9 aa, Borrelia afzelii
AELARDPSS

SEQ ID NO: 209722 - protein, 9 aa, Borrelia afzelii
ELARDPSST

SEQ ID NO: 209723 - protein, 9 aa, Borrelia afzelii
LARDPSSTK

SEQ ID NO: 209724 - protein, 9 aa, Borrelia afzelii
ARDPSSTKL

SEQ ID NO: 209725 - protein, 9 aa, Borrelia afzelii
RDPSSTKLD

SEQ ID NO: 209726 - protein, 9 aa, Borrelia afzelii
DPSSTKLDL

SEQ ID NO: 209727 - protein, 9 aa, Borrelia afzelii
PSSTKLDLT

SEQ ID NO: 209728 - protein, 9 aa, Borrelia afzelii
SSTKLDLTN

SEQ ID NO: 209729 - protein, 9 aa, Borrelia afzelii
STKLDLTNY

SEQ ID NO: 209730 - protein, 9 aa, Borrelia afzelii
TKLDLTNYV

SEQ ID NO: 209731 - protein, 9 aa, Borrelia afzelii
KLDLTNYVD

SEQ ID NO: 209732 - protein, 9 aa, Borrelia afzelii
LDLTNYVDY

SEQ ID NO: 209733 - protein, 9 aa, Borrelia afzelii
DLTNYVDYV

SEQ ID NO: 209734 - protein, 9 aa, Borrelia afzelii
LTNYVDYVY

SEQ ID NO: 209735 - protein, 9 aa, Borrelia afzelii
TNYVDYVYS

SEQ ID NO: 209736 - protein, 9 aa, Borrelia afzelii
NYVDYVYSG

SEQ ID NO: 209737 - protein, 9 aa, Borrelia afzelii
YVDYVYSGA

SEQ ID NO: 209738 - protein, 9 aa, Borrelia afzelii
VDYVYSGAS

SEQ ID NO: 209739 - protein, 9 aa, Borrelia afzelii
DYVYSGASG

SEQ ID NO: 209740 - protein, 9 aa, Borrelia afzelii
YVYSGASGI

SEQ ID NO: 209741 - protein, 9 aa, Borrelia afzelii
VYSGASGIV

SEQ ID NO: 209742 - protein, 9 aa, Borrelia afzelii
YSGASGIVK

SEQ ID NO: 209743 - protein, 9 aa, Borrelia afzelii
SGASGIVKP

SEQ ID NO: 209744 - protein, 9 aa, Borrelia afzelii
GASGIVKPE

SEQ ID NO: 209745 - protein, 9 aa, Borrelia afzelii
ASGIVKPED

SEQ ID NO: 209746 - protein, 9 aa, Borrelia afzelii
SGIVKPEDM

SEQ ID NO: 209747 - protein, 9 aa, Borrelia afzelii
GIVKPEDMV

SEQ ID NO: 209748 - protein, 9 aa, Borrelia afzelii
IVKPEDMVV

SEQ ID NO: 209749 - protein, 9 aa, Borrelia afzelii
VKPEDMVVD

SEQ ID NO: 209750 - protein, 9 aa, Borrelia afzelii
KPEDMVVDL

SEQ ID NO: 209751 - protein, 9 aa, Borrelia afzelii
PEDMVVDLG

SEQ ID NO: 209752 - protein, 9 aa, Borrelia afzelii
EDMVVDLGI

SEQ ID NO: 209753 - protein, 9 aa, Borrelia afzelii
DMVVDLGIS

SEQ ID NO: 209754 - protein, 9 aa, Borrelia afzelii
MVVDLGISN

SEQ ID NO: 209755 - protein, 9 aa, Borrelia afzelii
VVDLGISNW

SEQ ID NO: 209756 - protein, 9 aa, Borrelia afzelii
VDLGISNWS

SEQ ID NO: 209757 - protein, 9 aa, Borrelia afzelii
DLGISNWSV

SEQ ID NO: 209758 - protein, 9 aa, Borrelia afzelii
LGISNWSVL

SEQ ID NO: 209759 - protein, 9 aa, Borrelia afzelii
GISNWSVLL

SEQ ID NO: 209760 - protein, 9 aa, Borrelia afzelii
ISNWSVLLT

SEQ ID NO: 209761 - protein, 9 aa, Borrelia afzelii
SNWSVLLTP

SEQ ID NO: 209762 - protein, 9 aa, Borrelia afzelii
NWSVLLTPS

SEQ ID NO: 209763 - protein, 9 aa, Borrelia afzelii
WSVLLTPSA

SEQ ID NO: 209764 - protein, 9 aa, Borrelia afzelii
SVLLTPSAR

SEQ ID NO: 209765 - protein, 9 aa, Borrelia afzelii
VLLTPSARL

SEQ ID NO: 209766 - protein, 9 aa, Borrelia afzelii
LLTPSARLQ

SEQ ID NO: 209767 - protein, 9 aa, Borrelia afzelii
LTPSARLQA

SEQ ID NO: 209768 - protein, 9 aa, Borrelia afzelii
TPSARLQAY

SEQ ID NO: 209769 - protein, 9 aa, Borrelia afzelii
PSARLQAYV

SEQ ID NO: 209770 - protein, 9 aa, Borrelia afzelii
SARLQAYVK

SEQ ID NO: 209771 - protein, 9 aa, Borrelia afzelii
ARLQAYVKN

SEQ ID NO: 209772 - protein, 9 aa, Borrelia afzelii
RLQAYVKNS

SEQ ID NO: 209773 - protein, 9 aa, Borrelia afzelii
LQAYVKNSV

SEQ ID NO: 209774 - protein, 9 aa, Borrelia afzelii
QAYVKNSVV

SEQ ID NO: 209775 - protein, 9 aa, Borrelia afzelii
AYVKNSVVA

SEQ ID NO: 209776 - protein, 9 aa, Borrelia afzelii
YVKNSVVAP

SEQ ID NO: 209777 - protein, 9 aa, Borrelia afzelii
VKNSVVAPA

SEQ ID NO: 209778 - protein, 9 aa, Borrelia afzelii
KNSVVAPAL

SEQ ID NO: 209779 - protein, 9 aa, Borrelia afzelii
NSVVAPALV

SEQ ID NO: 209780 - protein, 9 aa, Borrelia afzelii
SVVAPALVK

SEQ ID NO: 209781 - protein, 9 aa, Borrelia afzelii
VVAPALVKS

SEQ ID NO: 209782 - protein, 9 aa, Borrelia afzelii
VAPALVKSE

SEQ ID NO: 209783 - protein, 9 aa, Borrelia afzelii
APALVKSES

SEQ ID NO: 209784 - protein, 9 aa, Borrelia afzelii
PALVKSESK

SEQ ID NO: 209785 - protein, 9 aa, Borrelia afzelii
ALVKSESKR

SEQ ID NO: 209786 - protein, 9 aa, Borrelia afzelii
LVKSESKRY

SEQ ID NO: 209787 - protein, 9 aa, Borrelia afzelii
VKSESKRYA

SEQ ID NO: 209788 - protein, 9 aa, Borrelia afzelii
KSESKRYAG

SEQ ID NO: 209789 - protein, 9 aa, Borrelia afzelii
SESKRYAGD

SEQ ID NO: 209790 - protein, 9 aa, Borrelia afzelii
ESKRYAGDT

SEQ ID NO: 209791 - protein, 9 aa, Borrelia afzelii
SKRYAGDTI

SEQ ID NO: 209792 - protein, 9 aa, Borrelia afzelii
KRYAGDTIL

SEQ ID NO: 209793 - protein, 9 aa, Borrelia afzelii
RYAGDTILG

SEQ ID NO: 209794 - protein, 9 aa, Borrelia afzelii
YAGDTILGV

SEQ ID NO: 209795 - protein, 9 aa, Borrelia afzelii
AGDTILGVR

SEQ ID NO: 209796 - protein, 9 aa, Borrelia afzelii
GDTILGVRV

SEQ ID NO: 209797 - protein, 9 aa, Borrelia afzelii
DTILGVRVL

SEQ ID NO: 209798 - protein, 9 aa, Borrelia afzelii
TILGVRVLF

SEQ ID NO: 209799 - protein, 9 aa, Borrelia afzelii
ILGVRVLFP

SEQ ID NO: 209800 - protein, 9 aa, Borrelia afzelii
LGVRVLFPS

SEQ ID NO: 209801 - protein, 9 aa, Borrelia afzelii
GVRVLFPSY

SEQ ID NO: 209802 - protein, 9 aa, Borrelia afzelii
VRVLFPSYS

SEQ ID NO: 209803 - protein, 9 aa, Borrelia afzelii
RVLFPSYSQ

SEQ ID NO: 209804 - protein, 9 aa, Borrelia afzelii
VLFPSYSQS

SEQ ID NO: 209805 - protein, 9 aa, Borrelia afzelii
LFPSYSQSS

SEQ ID NO: 209806 - protein, 9 aa, Borrelia afzelii
FPSYSQSSA

SEQ ID NO: 209807 - protein, 9 aa, Borrelia afzelii
PSYSQSSAM

SEQ ID NO: 209808 - protein, 9 aa, Borrelia afzelii
SYSQSSAMI

SEQ ID NO: 209809 - protein, 9 aa, Borrelia afzelii
YSQSSAMIM

SEQ ID NO: 209810 - protein, 9 aa, Borrelia afzelii
SQSSAMIMP

SEQ ID NO: 209811 - protein, 9 aa, Borrelia afzelii
QSSAMIMPP

SEQ ID NO: 209812 - protein, 9 aa, Borrelia afzelii
SSAMIMPPF

SEQ ID NO: 209813 - protein, 9 aa, Borrelia afzelii
SAMIMPPFK

SEQ ID NO: 209814 - protein, 9 aa, Borrelia afzelii
AMIMPPFKI

SEQ ID NO: 209815 - protein, 9 aa, Borrelia afzelii
MIMPPFKIP

SEQ ID NO: 209816 - protein, 9 aa, Borrelia afzelii
IMPPFKIPF

SEQ ID NO: 209817 - protein, 9 aa, Borrelia afzelii
MPPFKIPFY

SEQ ID NO: 209818 - protein, 9 aa, Borrelia afzelii
PPFKIPFYS

SEQ ID NO: 209819 - protein, 9 aa, Borrelia afzelii
PFKIPFYSG

SEQ ID NO: 209820 - protein, 9 aa, Borrelia afzelii
FKIPFYSGE

SEQ ID NO: 209821 - protein, 9 aa, Borrelia afzelii
KIPFYSGES

SEQ ID NO: 209822 - protein, 9 aa, Borrelia afzelii
IPFYSGESG

SEQ ID NO: 209823 - protein, 9 aa, Borrelia afzelii
PFYSGESGN

SEQ ID NO: 209824 - protein, 9 aa, Borrelia afzelii
FYSGESGNQ

SEQ ID NO: 209825 - protein, 9 aa, Borrelia afzelii
YSGESGNQF

SEQ ID NO: 209826 - protein, 9 aa, Borrelia afzelii
SGESGNQFL

SEQ ID NO: 209827 - protein, 9 aa, Borrelia afzelii
GESGNQFLG

SEQ ID NO: 209828 - protein, 9 aa, Borrelia afzelii
ESGNQFLGK

SEQ ID NO: 209829 - protein, 9 aa, Borrelia afzelii
SGNQFLGKG

SEQ ID NO: 209830 - protein, 9 aa, Borrelia afzelii
GNQFLGKGL

SEQ ID NO: 209831 - protein, 9 aa, Borrelia afzelii
NQFLGKGLI

SEQ ID NO: 209832 - protein, 9 aa, Borrelia afzelii
QFLGKGLID

SEQ ID NO: 209833 - protein, 9 aa, Borrelia afzelii
FLGKGLIDN

SEQ ID NO: 209834 - protein, 9 aa, Borrelia afzelii
LGKGLIDNI

SEQ ID NO: 209835 - protein, 9 aa, Borrelia afzelii
GKGLIDNIK

SEQ ID NO: 209836 - protein, 9 aa, Borrelia afzelii
KGLIDNIKT

SEQ ID NO: 209837 - protein, 9 aa, Borrelia afzelii
GLIDNIKTM

SEQ ID NO: 209838 - protein, 9 aa, Borrelia afzelii
LIDNIKTMK

SEQ ID NO: 209839 - protein, 9 aa, Borrelia afzelii
IDNIKTMKE

SEQ ID NO: 209840 - protein, 9 aa, Borrelia afzelii
DNIKTMKEI

SEQ ID NO: 209841 - protein, 9 aa, Borrelia afzelii
NIKTMKEIK

SEQ ID NO: 209842 - protein, 9 aa, Borrelia afzelii
IKTMKEIKV

SEQ ID NO: 209843 - protein, 9 aa, Borrelia afzelii
KTMKEIKVS

SEQ ID NO: 209844 - protein, 9 aa, Borrelia afzelii
TMKEIKVSV

SEQ ID NO: 209845 - protein, 9 aa, Borrelia afzelii
MKEIKVSVY

SEQ ID NO: 209846 - protein, 9 aa, Borrelia afzelii
KEIKVSVYS

SEQ ID NO: 209847 - protein, 9 aa, Borrelia afzelii
EIKVSVYSL

SEQ ID NO: 209848 - protein, 9 aa, Borrelia afzelii
IKVSVYSLG

SEQ ID NO: 209849 - protein, 9 aa, Borrelia afzelii
KVSVYSLGY

SEQ ID NO: 209850 - protein, 9 aa, Borrelia afzelii
VSVYSLGYE

SEQ ID NO: 209851 - protein, 9 aa, Borrelia afzelii
SVYSLGYEV

SEQ ID NO: 209852 - protein, 9 aa, Borrelia afzelii
VYSLGYEVD

SEQ ID NO: 209853 - protein, 9 aa, Borrelia afzelii
YSLGYEVDL

SEQ ID NO: 209854 - protein, 9 aa, Borrelia afzelii
SLGYEVDLE

SEQ ID NO: 209855 - protein, 9 aa, Borrelia afzelii
LGYEVDLEV

SEQ ID NO: 209856 - protein, 9 aa, Borrelia afzelii
GYEVDLEVL

SEQ ID NO: 209857 - protein, 9 aa, Borrelia afzelii
YEVDLEVLF

SEQ ID NO: 209858 - protein, 9 aa, Borrelia afzelii
EVDLEVLFE

SEQ ID NO: 209859 - protein, 9 aa, Borrelia afzelii
VDLEVLFED

SEQ ID NO: 209860 - protein, 9 aa, Borrelia afzelii
DLEVLFEDM

SEQ ID NO: 209861 - protein, 9 aa, Borrelia afzelii
LEVLFEDMN

SEQ ID NO: 209862 - protein, 9 aa, Borrelia afzelii
EVLFEDMNG

SEQ ID NO: 209863 - protein, 9 aa, Borrelia afzelii
VLFEDMNGM

SEQ ID NO: 209864 - protein, 9 aa, Borrelia afzelii
LFEDMNGME

SEQ ID NO: 209865 - protein, 9 aa, Borrelia afzelii
FEDMNGMEY

SEQ ID NO: 209866 - protein, 9 aa, Borrelia afzelii
EDMNGMEYA

SEQ ID NO: 209867 - protein, 9 aa, Borrelia afzelii
DMNGMEYAY

SEQ ID NO: 209868 - protein, 9 aa, Borrelia afzelii
MNGMEYAYS

SEQ ID NO: 209869 - protein, 9 aa, Borrelia afzelii
NGMEYAYSL

SEQ ID NO: 209870 - protein, 9 aa, Borrelia afzelii
GMEYAYSLG

SEQ ID NO: 209871 - protein, 9 aa, Borrelia afzelii
MEYAYSLGT

SEQ ID NO: 209872 - protein, 9 aa, Borrelia afzelii
EYAYSLGTL

SEQ ID NO: 209873 - protein, 9 aa, Borrelia afzelii
YAYSLGTLK

SEQ ID NO: 209874 - protein, 9 aa, Borrelia afzelii
AYSLGTLKF

SEQ ID NO: 209875 - protein, 9 aa, Borrelia afzelii
YSLGTLKFK

SEQ ID NO: 209876 - protein, 9 aa, Borrelia afzelii
SLGTLKFKG

SEQ ID NO: 209877 - protein, 9 aa, Borrelia afzelii
LGTLKFKGW

SEQ ID NO: 209878 - protein, 9 aa, Borrelia afzelii
GTLKFKGWA

SEQ ID NO: 209879 - protein, 9 aa, Borrelia afzelii
TLKFKGWAD

SEQ ID NO: 209880 - protein, 9 aa, Borrelia afzelii
LKFKGWADL

SEQ ID NO: 209881 - protein, 9 aa, Borrelia afzelii
KFKGWADLI

SEQ ID NO: 209882 - protein, 9 aa, Borrelia afzelii
FKGWADLIW

SEQ ID NO: 209883 - protein, 9 aa, Borrelia afzelii
KGWADLIWS

SEQ ID NO: 209884 - protein, 9 aa, Borrelia afzelii
GWADLIWSN

SEQ ID NO: 209885 - protein, 9 aa, Borrelia afzelii
WADLIWSNP

SEQ ID NO: 209886 - protein, 9 aa, Borrelia afzelii
ADLIWSNPN

SEQ ID NO: 209887 - protein, 9 aa, Borrelia afzelii
DLIWSNPNY

SEQ ID NO: 209888 - protein, 9 aa, Borrelia afzelii
LIWSNPNYI

SEQ ID NO: 209889 - protein, 9 aa, Borrelia afzelii
IWSNPNYIP

SEQ ID NO: 209890 - protein, 9 aa, Borrelia afzelii
WSNPNYIPN

SEQ ID NO: 209891 - protein, 9 aa, Borrelia afzelii
SNPNYIPNI

SEQ ID NO: 209892 - protein, 9 aa, Borrelia afzelii
NPNYIPNIS

SEQ ID NO: 209893 - protein, 9 aa, Borrelia afzelii
PNYIPNISA

SEQ ID NO: 209894 - protein, 9 aa, Borrelia afzelii
NYIPNISAR

SEQ ID NO: 209895 - protein, 9 aa, Borrelia afzelii
YIPNISARI

SEQ ID NO: 209896 - protein, 9 aa, Borrelia afzelii
IPNISARII

SEQ ID NO: 209897 - protein, 9 aa, Borrelia afzelii
PNISARIIK

SEQ ID NO: 209898 - protein, 9 aa, Borrelia afzelii
NISARIIKD

SEQ ID NO: 209899 - protein, 9 aa, Borrelia afzelii
ISARIIKDD

SEQ ID NO: 209900 - protein, 9 aa, Borrelia afzelii
SARIIKDDV

SEQ ID NO: 209901 - protein, 9 aa, Borrelia afzelii
ARIIKDDVP

SEQ ID NO: 209902 - protein, 9 aa, Borrelia afzelii
RIIKDDVPN

SEQ ID NO: 209903 - protein, 9 aa, Borrelia afzelii
IIKDDVPNY

SEQ ID NO: 209904 - protein, 9 aa, Borrelia afzelii
IKDDVPNYP

SEQ ID NO: 209905 - protein, 9 aa, Borrelia afzelii
KDDVPNYPL

SEQ ID NO: 209906 - protein, 9 aa, Borrelia afzelii
DDVPNYPLA

SEQ ID NO: 209907 - protein, 9 aa, Borrelia afzelii
DVPNYPLAS

SEQ ID NO: 209908 - protein, 9 aa, Borrelia afzelii
VPNYPLASS

SEQ ID NO: 209909 - protein, 9 aa, Borrelia afzelii
PNYPLASSK

SEQ ID NO: 209910 - protein, 9 aa, Borrelia afzelii
NYPLASSKM

SEQ ID NO: 209911 - protein, 9 aa, Borrelia afzelii
YPLASSKMR

SEQ ID NO: 209912 - protein, 9 aa, Borrelia afzelii
PLASSKMRF

SEQ ID NO: 209913 - protein, 9 aa, Borrelia afzelii
LASSKMRFK

SEQ ID NO: 209914 - protein, 9 aa, Borrelia afzelii
ASSKMRFKA

SEQ ID NO: 209915 - protein, 9 aa, Borrelia afzelii
SSKMRFKAF

SEQ ID NO: 209916 - protein, 9 aa, Borrelia afzelii
SKMRFKAFR

SEQ ID NO: 209917 - protein, 9 aa, Borrelia afzelii
KMRFKAFRV

SEQ ID NO: 209918 - protein, 9 aa, Borrelia afzelii
MRFKAFRVS

SEQ ID NO: 209919 - protein, 9 aa, Borrelia afzelii
RFKAFRVSK

SEQ ID NO: 209920 - protein, 9 aa, Borrelia afzelii
FKAFRVSKS

SEQ ID NO: 209921 - protein, 9 aa, Borrelia afzelii
KAFRVSKSH

SEQ ID NO: 209922 - protein, 9 aa, Borrelia afzelii
AFRVSKSHS

SEQ ID NO: 209923 - protein, 9 aa, Borrelia afzelii
FRVSKSHSS

SEQ ID NO: 209924 - protein, 9 aa, Borrelia afzelii
RVSKSHSSK

SEQ ID NO: 209925 - protein, 9 aa, Borrelia afzelii
VSKSHSSKE

SEQ ID NO: 209926 - protein, 9 aa, Borrelia afzelii
SKSHSSKEQ

SEQ ID NO: 209927 - protein, 9 aa, Borrelia afzelii
KSHSSKEQN

SEQ ID NO: 209928 - protein, 9 aa, Borrelia afzelii
SHSSKEQNF

SEQ ID NO: 209929 - protein, 9 aa, Borrelia afzelii
HSSKEQNFI

SEQ ID NO: 209930 - protein, 9 aa, Borrelia afzelii
SSKEQNFIF

SEQ ID NO: 209931 - protein, 9 aa, Borrelia afzelii
SKEQNFIFY

SEQ ID NO: 209932 - protein, 9 aa, Borrelia afzelii
KEQNFIFYV

SEQ ID NO: 209933 - protein, 9 aa, Borrelia afzelii
EQNFIFYVK

SEQ ID NO: 209934 - protein, 9 aa, Borrelia afzelii
QNFIFYVKD

SEQ ID NO: 209935 - protein, 9 aa, Borrelia afzelii
NFIFYVKDL

SEQ ID NO: 209936 - protein, 9 aa, Borrelia afzelii
FIFYVKDLR

SEQ ID NO: 209937 - protein, 9 aa, Borrelia afzelii
IFYVKDLRV

SEQ ID NO: 209938 - protein, 9 aa, Borrelia afzelii
FYVKDLRVL

SEQ ID NO: 209939 - protein, 9 aa, Borrelia afzelii
YVKDLRVLY

SEQ ID NO: 209940 - protein, 9 aa, Borrelia afzelii
VKDLRVLYD

SEQ ID NO: 209941 - protein, 9 aa, Borrelia afzelii
KDLRVLYDK

SEQ ID NO: 209942 - protein, 9 aa, Borrelia afzelii
DLRVLYDKL

SEQ ID NO: 209943 - protein, 9 aa, Borrelia afzelii
LRVLYDKLS

SEQ ID NO: 209944 - protein, 9 aa, Borrelia afzelii
RVLYDKLSV

SEQ ID NO: 209945 - protein, 9 aa, Borrelia afzelii
VLYDKLSVS

SEQ ID NO: 209946 - protein, 9 aa, Borrelia afzelii
LYDKLSVSI

SEQ ID NO: 209947 - protein, 9 aa, Borrelia afzelii
YDKLSVSID

SEQ ID NO: 209948 - protein, 9 aa, Borrelia afzelii
DKLSVSIDS

SEQ ID NO: 209949 - protein, 9 aa, Borrelia afzelii
KLSVSIDSD

SEQ ID NO: 209950 - protein, 9 aa, Borrelia afzelii
LSVSIDSDI

SEQ ID NO: 209951 - protein, 9 aa, Borrelia afzelii
SVSIDSDID

SEQ ID NO: 209952 - protein, 9 aa, Borrelia afzelii
VSIDSDIDS

SEQ ID NO: 209953 - protein, 9 aa, Borrelia afzelii
SIDSDIDSE

SEQ ID NO: 209954 - protein, 9 aa, Borrelia afzelii
IDSDIDSES

SEQ ID NO: 209955 - protein, 9 aa, Borrelia afzelii
DSDIDSESV

SEQ ID NO: 209956 - protein, 9 aa, Borrelia afzelii
SDIDSESVF

SEQ ID NO: 209957 - protein, 9 aa, Borrelia afzelii
DIDSESVFK

SEQ ID NO: 209958 - protein, 9 aa, Borrelia afzelii
IDSESVFKV

SEQ ID NO: 209959 - protein, 9 aa, Borrelia afzelii
DSESVFKVY

SEQ ID NO: 209960 - protein, 9 aa, Borrelia afzelii
SESVFKVYE

SEQ ID NO: 209961 - protein, 9 aa, Borrelia afzelii
ESVFKVYET

SEQ ID NO: 209962 - protein, 9 aa, Borrelia afzelii
SVFKVYETS

SEQ ID NO: 209963 - protein, 9 aa, Borrelia afzelii
VFKVYETSG

SEQ ID NO: 209964 - protein, 9 aa, Borrelia afzelii
FKVYETSGA

SEQ ID NO: 209965 - protein, 9 aa, Borrelia afzelii
KVYETSGAE

SEQ ID NO: 209966 - protein, 9 aa, Borrelia afzelii
VYETSGAES

SEQ ID NO: 209967 - protein, 9 aa, Borrelia afzelii
YETSGAESL

SEQ ID NO: 209968 - protein, 9 aa, Borrelia afzelii
ETSGAESLR

SEQ ID NO: 209969 - protein, 9 aa, Borrelia afzelii
TSGAESLRK

SEQ ID NO: 209970 - protein, 9 aa, Borrelia afzelii
SGAESLRKL

SEQ ID NO: 209971 - protein, 9 aa, Borrelia afzelii
GAESLRKLK

SEQ ID NO: 209972 - protein, 9 aa, Borrelia afzelii
AESLRKLKA

SEQ ID NO: 209973 - protein, 9 aa, Borrelia afzelii
ESLRKLKAH

SEQ ID NO: 209974 - protein, 9 aa, Borrelia afzelii
SLRKLKAHE

SEQ ID NO: 209975 - protein, 9 aa, Borrelia afzelii
LRKLKAHET

SEQ ID NO: 209976 - protein, 9 aa, Borrelia afzelii
RKLKAHETF

SEQ ID NO: 209977 - protein, 9 aa, Borrelia afzelii
KLKAHETFK

SEQ ID NO: 209978 - protein, 9 aa, Borrelia afzelii
LKAHETFKR

SEQ ID NO: 209979 - protein, 9 aa, Borrelia afzelii
KAHETFKRV

SEQ ID NO: 209980 - protein, 9 aa, Borrelia afzelii
AHETFKRVL

SEQ ID NO: 209981 - protein, 9 aa, Borrelia afzelii
HETFKRVLK

SEQ ID NO: 209982 - protein, 9 aa, Borrelia afzelii
ETFKRVLKL

SEQ ID NO: 209983 - protein, 9 aa, Borrelia afzelii
TFKRVLKLR

SEQ ID NO: 209984 - protein, 9 aa, Borrelia afzelii
FKRVLKLRE

SEQ ID NO: 209985 - protein, 9 aa, Borrelia afzelii
KRVLKLREK

SEQ ID NO: 209986 - protein, 9 aa, Borrelia afzelii
RVLKLREKI

SEQ ID NO: 209987 - protein, 9 aa, Borrelia afzelii
VLKLREKIS

SEQ ID NO: 209988 - protein, 9 aa, Borrelia afzelii
LKLREKISM

SEQ ID NO: 209989 - protein, 9 aa, Borrelia afzelii
KLREKISMP

SEQ ID NO: 209990 - protein, 9 aa, Borrelia afzelii
LREKISMPE

SEQ ID NO: 209991 - protein, 9 aa, Borrelia afzelii
REKISMPEG

SEQ ID NO: 209992 - protein, 9 aa, Borrelia afzelii
EKISMPEGS

SEQ ID NO: 209993 - protein, 9 aa, Borrelia afzelii
KISMPEGSF

SEQ ID NO: 209994 - protein, 9 aa, Borrelia afzelii
ISMPEGSFQ

SEQ ID NO: 209995 - protein, 9 aa, Borrelia afzelii
SMPEGSFQN

SEQ ID NO: 209996 - protein, 9 aa, Borrelia afzelii
MPEGSFQNF

SEQ ID NO: 209997 - protein, 9 aa, Borrelia afzelii
PEGSFQNFI

SEQ ID NO: 209998 - protein, 9 aa, Borrelia afzelii
EGSFQNFIE

SEQ ID NO: 209999 - protein, 9 aa, Borrelia afzelii
GSFQNFIEK

SEQ ID NO: 210000 - protein, 9 aa, Borrelia afzelii
SFQNFIEKV

SEQ ID NO: 210001 - protein, 9 aa, Borrelia afzelii
FQNFIEKVE

SEQ ID NO: 210002 - protein, 9 aa, Borrelia afzelii
QNFIEKVES

SEQ ID NO: 210003 - protein, 9 aa, Borrelia afzelii
NFIEKVESD

SEQ ID NO: 210004 - protein, 9 aa, Borrelia afzelii
FIEKVESDK

SEQ ID NO: 210005 - protein, 9 aa, Borrelia afzelii
IEKVESDKP

SEQ ID NO: 210006 - protein, 9 aa, Borrelia afzelii
EKVESDKPE

SEQ ID NO: 210007 - protein, 9 aa, Borrelia afzelii
KVESDKPEE

SEQ ID NO: 210008 - protein, 9 aa, Borrelia afzelii
VESDKPEES

SEQ ID NO: 210009 - protein, 9 aa, Borrelia afzelii
ESDKPEESS

SEQ ID NO: 210010 - protein, 9 aa, Borrelia afzelii
SDKPEESSS

SEQ ID NO: 210011 - protein, 9 aa, Borrelia afzelii
DKPEESSSE

SEQ ID NO: 210012 - protein, 9 aa, Borrelia afzelii
KPEESSSEN

SEQ ID NO: 210013 - protein, 10 aa, Borrelia afzelii
MKRKAKSILF

SEQ ID NO: 210014 - protein, 10 aa, Borrelia afzelii
KRKAKSILFF

SEQ ID NO: 210015 - protein, 10 aa, Borrelia afzelii
RKAKSILFFL

SEQ ID NO: 210016 - protein, 10 aa, Borrelia afzelii
KAKSILFFLL

SEQ ID NO: 210017 - protein, 10 aa, Borrelia afzelii
AKSILFFLLS

SEQ ID NO: 210018 - protein, 10 aa, Borrelia afzelii
KSILFFLLST

SEQ ID NO: 210019 - protein, 10 aa, Borrelia afzelii
SILFFLLSTA

SEQ ID NO: 210020 - protein, 10 aa, Borrelia afzelii
ILFFLLSTAL

SEQ ID NO: 210021 - protein, 10 aa, Borrelia afzelii
LFFLLSTALF

SEQ ID NO: 210022 - protein, 10 aa, Borrelia afzelii
FFLLSTALFA

SEQ ID NO: 210023 - protein, 10 aa, Borrelia afzelii
FLLSTALFAQ

SEQ ID NO: 210024 - protein, 10 aa, Borrelia afzelii
LLSTALFAQE

SEQ ID NO: 210025 - protein, 10 aa, Borrelia afzelii
LSTALFAQET

SEQ ID NO: 210026 - protein, 10 aa, Borrelia afzelii
STALFAQETD

SEQ ID NO: 210027 - protein, 10 aa, Borrelia afzelii
TALFAQETDG

SEQ ID NO: 210028 - protein, 10 aa, Borrelia afzelii
ALFAQETDGL

SEQ ID NO: 210029 - protein, 10 aa, Borrelia afzelii
LFAQETDGLT

SEQ ID NO: 210030 - protein, 10 aa, Borrelia afzelii
FAQETDGLTE

SEQ ID NO: 210031 - protein, 10 aa, Borrelia afzelii
AQETDGLTEG

SEQ ID NO: 210032 - protein, 10 aa, Borrelia afzelii
QETDGLTEGS

SEQ ID NO: 210033 - protein, 10 aa, Borrelia afzelii
ETDGLTEGSK

SEQ ID NO: 210034 - protein, 10 aa, Borrelia afzelii
TDGLTEGSKR

SEQ ID NO: 210035 - protein, 10 aa, Borrelia afzelii
DGLTEGSKRA

SEQ ID NO: 210036 - protein, 10 aa, Borrelia afzelii
GLTEGSKRAE

SEQ ID NO: 210037 - protein, 10 aa, Borrelia afzelii
LTEGSKRAEP

SEQ ID NO: 210038 - protein, 10 aa, Borrelia afzelii
TEGSKRAEPG

SEQ ID NO: 210039 - protein, 10 aa, Borrelia afzelii
EGSKRAEPGE

SEQ ID NO: 210040 - protein, 10 aa, Borrelia afzelii
GSKRAEPGEL

SEQ ID NO: 210041 - protein, 10 aa, Borrelia afzelii
SKRAEPGELV

SEQ ID NO: 210042 - protein, 10 aa, Borrelia afzelii
KRAEPGELVL

SEQ ID NO: 210043 - protein, 10 aa, Borrelia afzelii
RAEPGELVLD

SEQ ID NO: 210044 - protein, 10 aa, Borrelia afzelii
AEPGELVLDF

SEQ ID NO: 210045 - protein, 10 aa, Borrelia afzelii
EPGELVLDFA

SEQ ID NO: 210046 - protein, 10 aa, Borrelia afzelii
PGELVLDFAE

SEQ ID NO: 210047 - protein, 10 aa, Borrelia afzelii
GELVLDFAEL

SEQ ID NO: 210048 - protein, 10 aa, Borrelia afzelii
ELVLDFAELA

SEQ ID NO: 210049 - protein, 10 aa, Borrelia afzelii
LVLDFAELAR

SEQ ID NO: 210050 - protein, 10 aa, Borrelia afzelii
VLDFAELARD

SEQ ID NO: 210051 - protein, 10 aa, Borrelia afzelii
LDFAELARDP

SEQ ID NO: 210052 - protein, 10 aa, Borrelia afzelii
DFAELARDPS

SEQ ID NO: 210053 - protein, 10 aa, Borrelia afzelii
FAELARDPSS

SEQ ID NO: 210054 - protein, 10 aa, Borrelia afzelii
AELARDPSST

SEQ ID NO: 210055 - protein, 10 aa, Borrelia afzelii
ELARDPSSTK

SEQ ID NO: 210056 - protein, 10 aa, Borrelia afzelii
LARDPSSTKL

SEQ ID NO: 210057 - protein, 10 aa, Borrelia afzelii
ARDPSSTKLD

SEQ ID NO: 210058 - protein, 10 aa, Borrelia afzelii
RDPSSTKLDL

SEQ ID NO: 210059 - protein, 10 aa, Borrelia afzelii
DPSSTKLDLT

SEQ ID NO: 210060 - protein, 10 aa, Borrelia afzelii
PSSTKLDLTN

SEQ ID NO: 210061 - protein, 10 aa, Borrelia afzelii
SSTKLDLTNY

SEQ ID NO: 210062 - protein, 10 aa, Borrelia afzelii
STKLDLTNYV

SEQ ID NO: 210063 - protein, 10 aa, Borrelia afzelii
TKLDLTNYVD

SEQ ID NO: 210064 - protein, 10 aa, Borrelia afzelii
KLDLTNYVDY

SEQ ID NO: 210065 - protein, 10 aa, Borrelia afzelii
LDLTNYVDYV

SEQ ID NO: 210066 - protein, 10 aa, Borrelia afzelii
DLTNYVDYVY

SEQ ID NO: 210067 - protein, 10 aa, Borrelia afzelii
LTNYVDYVYS

SEQ ID NO: 210068 - protein, 10 aa, Borrelia afzelii
TNYVDYVYSG

SEQ ID NO: 210069 - protein, 10 aa, Borrelia afzelii
NYVDYVYSGA

SEQ ID NO: 210070 - protein, 10 aa, Borrelia afzelii
YVDYVYSGAS

SEQ ID NO: 210071 - protein, 10 aa, Borrelia afzelii
VDYVYSGASG

SEQ ID NO: 210072 - protein, 10 aa, Borrelia afzelii
DYVYSGASGI

SEQ ID NO: 210073 - protein, 10 aa, Borrelia afzelii
YVYSGASGIV

SEQ ID NO: 210074 - protein, 10 aa, Borrelia afzelii
VYSGASGIVK

SEQ ID NO: 210075 - protein, 10 aa, Borrelia afzelii
YSGASGIVKP

SEQ ID NO: 210076 - protein, 10 aa, Borrelia afzelii
SGASGIVKPE

SEQ ID NO: 210077 - protein, 10 aa, Borrelia afzelii
GASGIVKPED

SEQ ID NO: 210078 - protein, 10 aa, Borrelia afzelii
ASGIVKPEDM

SEQ ID NO: 210079 - protein, 10 aa, Borrelia afzelii
SGIVKPEDMV

SEQ ID NO: 210080 - protein, 10 aa, Borrelia afzelii
GIVKPEDMVV

SEQ ID NO: 210081 - protein, 10 aa, Borrelia afzelii
IVKPEDMVVD

SEQ ID NO: 210082 - protein, 10 aa, Borrelia afzelii
VKPEDMVVDL

SEQ ID NO: 210083 - protein, 10 aa, Borrelia afzelii
KPEDMVVDLG

SEQ ID NO: 210084 - protein, 10 aa, Borrelia afzelii
PEDMVVDLGI

SEQ ID NO: 210085 - protein, 10 aa, Borrelia afzelii
EDMVVDLGIS

SEQ ID NO: 210086 - protein, 10 aa, Borrelia afzelii
DMVVDLGISN

SEQ ID NO: 210087 - protein, 10 aa, Borrelia afzelii
MVVDLGISNW

SEQ ID NO: 210088 - protein, 10 aa, Borrelia afzelii
VVDLGISNWS

SEQ ID NO: 210089 - protein, 10 aa, Borrelia afzelii
VDLGISNWSV

SEQ ID NO: 210090 - protein, 10 aa, Borrelia afzelii
DLGISNWSVL

SEQ ID NO: 210091 - protein, 10 aa, Borrelia afzelii
LGISNWSVLL

SEQ ID NO: 210092 - protein, 10 aa, Borrelia afzelii
GISNWSVLLT

SEQ ID NO: 210093 - protein, 10 aa, Borrelia afzelii
ISNWSVLLTP

SEQ ID NO: 210094 - protein, 10 aa, Borrelia afzelii
SNWSVLLTPS

SEQ ID NO: 210095 - protein, 10 aa, Borrelia afzelii
NWSVLLTPSA

SEQ ID NO: 210096 - protein, 10 aa, Borrelia afzelii
WSVLLTPSAR

SEQ ID NO: 210097 - protein, 10 aa, Borrelia afzelii
SVLLTPSARL

SEQ ID NO: 210098 - protein, 10 aa, Borrelia afzelii
VLLTPSARLQ

SEQ ID NO: 210099 - protein, 10 aa, Borrelia afzelii
LLTPSARLQA

SEQ ID NO: 210100 - protein, 10 aa, Borrelia afzelii
LTPSARLQAY

SEQ ID NO: 210101 - protein, 10 aa, Borrelia afzelii
TPSARLQAYV

SEQ ID NO: 210102 - protein, 10 aa, Borrelia afzelii
PSARLQAYVK

SEQ ID NO: 210103 - protein, 10 aa, Borrelia afzelii
SARLQAYVKN

SEQ ID NO: 210104 - protein, 10 aa, Borrelia afzelii
ARLQAYVKNS

SEQ ID NO: 210105 - protein, 10 aa, Borrelia afzelii
RLQAYVKNSV

SEQ ID NO: 210106 - protein, 10 aa, Borrelia afzelii
LQAYVKNSVV

SEQ ID NO: 210107 - protein, 10 aa, Borrelia afzelii
QAYVKNSVVA

SEQ ID NO: 210108 - protein, 10 aa, Borrelia afzelii
AYVKNSVVAP

SEQ ID NO: 210109 - protein, 10 aa, Borrelia afzelii
YVKNSVVAPA

SEQ ID NO: 210110 - protein, 10 aa, Borrelia afzelii
VKNSVVAPAL

SEQ ID NO: 210111 - protein, 10 aa, Borrelia afzelii
KNSVVAPALV

SEQ ID NO: 210112 - protein, 10 aa, Borrelia afzelii
NSVVAPALVK

SEQ ID NO: 210113 - protein, 10 aa, Borrelia afzelii
SVVAPALVKS

SEQ ID NO: 210114 - protein, 10 aa, Borrelia afzelii
VVAPALVKSE

SEQ ID NO: 210115 - protein, 10 aa, Borrelia afzelii
VAPALVKSES

SEQ ID NO: 210116 - protein, 10 aa, Borrelia afzelii
APALVKSESK

SEQ ID NO: 210117 - protein, 10 aa, Borrelia afzelii
PALVKSESKR

SEQ ID NO: 210118 - protein, 10 aa, Borrelia afzelii
ALVKSESKRY

SEQ ID NO: 210119 - protein, 10 aa, Borrelia afzelii
LVKSESKRYA

SEQ ID NO: 210120 - protein, 10 aa, Borrelia afzelii
VKSESKRYAG

SEQ ID NO: 210121 - protein, 10 aa, Borrelia afzelii
KSESKRYAGD

SEQ ID NO: 210122 - protein, 10 aa, Borrelia afzelii
SESKRYAGDT

SEQ ID NO: 210123 - protein, 10 aa, Borrelia afzelii
ESKRYAGDTI

SEQ ID NO: 210124 - protein, 10 aa, Borrelia afzelii
SKRYAGDTIL

SEQ ID NO: 210125 - protein, 10 aa, Borrelia afzelii
KRYAGDTILG

SEQ ID NO: 210126 - protein, 10 aa, Borrelia afzelii
RYAGDTILGV

SEQ ID NO: 210127 - protein, 10 aa, Borrelia afzelii
YAGDTILGVR

SEQ ID NO: 210128 - protein, 10 aa, Borrelia afzelii
AGDTILGVRV

SEQ ID NO: 210129 - protein, 10 aa, Borrelia afzelii
GDTILGVRVL

SEQ ID NO: 210130 - protein, 10 aa, Borrelia afzelii
DTILGVRVLF

SEQ ID NO: 210131 - protein, 10 aa, Borrelia afzelii
TILGVRVLFP

SEQ ID NO: 210132 - protein, 10 aa, Borrelia afzelii
ILGVRVLFPS

SEQ ID NO: 210133 - protein, 10 aa, Borrelia afzelii
LGVRVLFPSY

SEQ ID NO: 210134 - protein, 10 aa, Borrelia afzelii
GVRVLFPSYS

SEQ ID NO: 210135 - protein, 10 aa, Borrelia afzelii
VRVLFPSYSQ

SEQ ID NO: 210136 - protein, 10 aa, Borrelia afzelii
RVLFPSYSQS

SEQ ID NO: 210137 - protein, 10 aa, Borrelia afzelii
VLFPSYSQSS

SEQ ID NO: 210138 - protein, 10 aa, Borrelia afzelii
LFPSYSQSSA

SEQ ID NO: 210139 - protein, 10 aa, Borrelia afzelii
FPSYSQSSAM

SEQ ID NO: 210140 - protein, 10 aa, Borrelia afzelii
PSYSQSSAMI

SEQ ID NO: 210141 - protein, 10 aa, Borrelia afzelii
SYSQSSAMIM

SEQ ID NO: 210142 - protein, 10 aa, Borrelia afzelii
YSQSSAMIMP

SEQ ID NO: 210143 - protein, 10 aa, Borrelia afzelii
SQSSAMIMPP

SEQ ID NO: 210144 - protein, 10 aa, Borrelia afzelii
QSSAMIMPPF

SEQ ID NO: 210145 - protein, 10 aa, Borrelia afzelii
SSAMIMPPFK

SEQ ID NO: 210146 - protein, 10 aa, Borrelia afzelii
SAMIMPPFKI

SEQ ID NO: 210147 - protein, 10 aa, Borrelia afzelii
AMIMPPFKIP

SEQ ID NO: 210148 - protein, 10 aa, Borrelia afzelii
MIMPPFKIPF

SEQ ID NO: 210149 - protein, 10 aa, Borrelia afzelii
IMPPFKIPFY

SEQ ID NO: 210150 - protein, 10 aa, Borrelia afzelii
MPPFKIPFYS

SEQ ID NO: 210151 - protein, 10 aa, Borrelia afzelii
PPFKIPFYSG

SEQ ID NO: 210152 - protein, 10 aa, Borrelia afzelii
PFKIPFYSGE

SEQ ID NO: 210153 - protein, 10 aa, Borrelia afzelii
FKIPFYSGES

SEQ ID NO: 210154 - protein, 10 aa, Borrelia afzelii
KIPFYSGESG

SEQ ID NO: 210155 - protein, 10 aa, Borrelia afzelii
IPFYSGESGN

SEQ ID NO: 210156 - protein, 10 aa, Borrelia afzelii
PFYSGESGNQ

SEQ ID NO: 210157 - protein, 10 aa, Borrelia afzelii
FYSGESGNQF

SEQ ID NO: 210158 - protein, 10 aa, Borrelia afzelii
YSGESGNQFL

SEQ ID NO: 210159 - protein, 10 aa, Borrelia afzelii
SGESGNQFLG

SEQ ID NO: 210160 - protein, 10 aa, Borrelia afzelii
GESGNQFLGK

SEQ ID NO: 210161 - protein, 10 aa, Borrelia afzelii
ESGNQFLGKG

SEQ ID NO: 210162 - protein, 10 aa, Borrelia afzelii
SGNQFLGKGL

SEQ ID NO: 210163 - protein, 10 aa, Borrelia afzelii
GNQFLGKGLI

SEQ ID NO: 210164 - protein, 10 aa, Borrelia afzelii
NQFLGKGLID

SEQ ID NO: 210165 - protein, 10 aa, Borrelia afzelii
QFLGKGLIDN

SEQ ID NO: 210166 - protein, 10 aa, Borrelia afzelii
FLGKGLIDNI

SEQ ID NO: 210167 - protein, 10 aa, Borrelia afzelii
LGKGLIDNIK

SEQ ID NO: 210168 - protein, 10 aa, Borrelia afzelii
GKGLIDNIKT

SEQ ID NO: 210169 - protein, 10 aa, Borrelia afzelii
KGLIDNIKTM

SEQ ID NO: 210170 - protein, 10 aa, Borrelia afzelii
GLIDNIKTMK

SEQ ID NO: 210171 - protein, 10 aa, Borrelia afzelii
LIDNIKTMKE

SEQ ID NO: 210172 - protein, 10 aa, Borrelia afzelii
IDNIKTMKEI

SEQ ID NO: 210173 - protein, 10 aa, Borrelia afzelii
DNIKTMKEIK

SEQ ID NO: 210174 - protein, 10 aa, Borrelia afzelii
NIKTMKEIKV

SEQ ID NO: 210175 - protein, 10 aa, Borrelia afzelii
IKTMKEIKVS

SEQ ID NO: 210176 - protein, 10 aa, Borrelia afzelii
KTMKEIKVSV

SEQ ID NO: 210177 - protein, 10 aa, Borrelia afzelii
TMKEIKVSVY

SEQ ID NO: 210178 - protein, 10 aa, Borrelia afzelii
MKEIKVSVYS

SEQ ID NO: 210179 - protein, 10 aa, Borrelia afzelii
KEIKVSVYSL

SEQ ID NO: 210180 - protein, 10 aa, Borrelia afzelii
EIKVSVYSLG

SEQ ID NO: 210181 - protein, 10 aa, Borrelia afzelii
IKVSVYSLGY

SEQ ID NO: 210182 - protein, 10 aa, Borrelia afzelii
KVSVYSLGYE

SEQ ID NO: 210183 - protein, 10 aa, Borrelia afzelii
VSVYSLGYEV

SEQ ID NO: 210184 - protein, 10 aa, Borrelia afzelii
SVYSLGYEVD

SEQ ID NO: 210185 - protein, 10 aa, Borrelia afzelii
VYSLGYEVDL

SEQ ID NO: 210186 - protein, 10 aa, Borrelia afzelii
YSLGYEVDLE

SEQ ID NO: 210187 - protein, 10 aa, Borrelia afzelii
SLGYEVDLEV

SEQ ID NO: 210188 - protein, 10 aa, Borrelia afzelii
LGYEVDLEVL

SEQ ID NO: 210189 - protein, 10 aa, Borrelia afzelii
GYEVDLEVLF

SEQ ID NO: 210190 - protein, 10 aa, Borrelia afzelii
YEVDLEVLFE

SEQ ID NO: 210191 - protein, 10 aa, Borrelia afzelii
EVDLEVLFED

SEQ ID NO: 210192 - protein, 10 aa, Borrelia afzelii
VDLEVLFEDM

SEQ ID NO: 210193 - protein, 10 aa, Borrelia afzelii
DLEVLFEDMN

SEQ ID NO: 210194 - protein, 10 aa, Borrelia afzelii
LEVLFEDMNG

SEQ ID NO: 210195 - protein, 10 aa, Borrelia afzelii
EVLFEDMNGM

SEQ ID NO: 210196 - protein, 10 aa, Borrelia afzelii
VLFEDMNGME

SEQ ID NO: 210197 - protein, 10 aa, Borrelia afzelii
LFEDMNGMEY

SEQ ID NO: 210198 - protein, 10 aa, Borrelia afzelii
FEDMNGMEYA

SEQ ID NO: 210199 - protein, 10 aa, Borrelia afzelii
EDMNGMEYAY

SEQ ID NO: 210200 - protein, 10 aa, Borrelia afzelii
DMNGMEYAYS

SEQ ID NO: 210201 - protein, 10 aa, Borrelia afzelii
MNGMEYAYSL

SEQ ID NO: 210202 - protein, 10 aa, Borrelia afzelii
NGMEYAYSLG

SEQ ID NO: 210203 - protein, 10 aa, Borrelia afzelii
GMEYAYSLGT

SEQ ID NO: 210204 - protein, 10 aa, Borrelia afzelii
MEYAYSLGTL

SEQ ID NO: 210205 - protein, 10 aa, Borrelia afzelii
EYAYSLGTLK

SEQ ID NO: 210206 - protein, 10 aa, Borrelia afzelii
YAYSLGTLKF

SEQ ID NO: 210207 - protein, 10 aa, Borrelia afzelii
AYSLGTLKFK

SEQ ID NO: 210208 - protein, 10 aa, Borrelia afzelii
YSLGTLKFKG

SEQ ID NO: 210209 - protein, 10 aa, Borrelia afzelii
SLGTLKFKGW

SEQ ID NO: 210210 - protein, 10 aa, Borrelia afzelii
LGTLKFKGWA

SEQ ID NO: 210211 - protein, 10 aa, Borrelia afzelii
GTLKFKGWAD

SEQ ID NO: 210212 - protein, 10 aa, Borrelia afzelii
TLKFKGWADL

SEQ ID NO: 210213 - protein, 10 aa, Borrelia afzelii
LKFKGWADLI

SEQ ID NO: 210214 - protein, 10 aa, Borrelia afzelii
KFKGWADLIW

SEQ ID NO: 210215 - protein, 10 aa, Borrelia afzelii
FKGWADLIWS

SEQ ID NO: 210216 - protein, 10 aa, Borrelia afzelii
KGWADLIWSN

SEQ ID NO: 210217 - protein, 10 aa, Borrelia afzelii
GWADLIWSNP

SEQ ID NO: 210218 - protein, 10 aa, Borrelia afzelii
WADLIWSNPN

SEQ ID NO: 210219 - protein, 10 aa, Borrelia afzelii
ADLIWSNPNY

SEQ ID NO: 210220 - protein, 10 aa, Borrelia afzelii
DLIWSNPNYI

SEQ ID NO: 210221 - protein, 10 aa, Borrelia afzelii
LIWSNPNYIP

SEQ ID NO: 210222 - protein, 10 aa, Borrelia afzelii
IWSNPNYIPN

SEQ ID NO: 210223 - protein, 10 aa, Borrelia afzelii
WSNPNYIPNI

SEQ ID NO: 210224 - protein, 10 aa, Borrelia afzelii
SNPNYIPNIS

SEQ ID NO: 210225 - protein, 10 aa, Borrelia afzelii
NPNYIPNISA

SEQ ID NO: 210226 - protein, 10 aa, Borrelia afzelii
PNYIPNISAR

SEQ ID NO: 210227 - protein, 10 aa, Borrelia afzelii
NYIPNISARI

SEQ ID NO: 210228 - protein, 10 aa, Borrelia afzelii
YIPNISARII

SEQ ID NO: 210229 - protein, 10 aa, Borrelia afzelii
IPNISARIIK

SEQ ID NO: 210230 - protein, 10 aa, Borrelia afzelii
PNISARIIKD

SEQ ID NO: 210231 - protein, 10 aa, Borrelia afzelii
NISARIIKDD

SEQ ID NO: 210232 - protein, 10 aa, Borrelia afzelii
ISARIIKDDV

SEQ ID NO: 210233 - protein, 10 aa, Borrelia afzelii
SARIIKDDVP

SEQ ID NO: 210234 - protein, 10 aa, Borrelia afzelii
ARIIKDDVPN

SEQ ID NO: 210235 - protein, 10 aa, Borrelia afzelii
RIIKDDVPNY

SEQ ID NO: 210236 - protein, 10 aa, Borrelia afzelii
IIKDDVPNYP

SEQ ID NO: 210237 - protein, 10 aa, Borrelia afzelii
IKDDVPNYPL

SEQ ID NO: 210238 - protein, 10 aa, Borrelia afzelii
KDDVPNYPLA

SEQ ID NO: 210239 - protein, 10 aa, Borrelia afzelii
DDVPNYPLAS

SEQ ID NO: 210240 - protein, 10 aa, Borrelia afzelii
DVPNYPLASS

SEQ ID NO: 210241 - protein, 10 aa, Borrelia afzelii
VPNYPLASSK

SEQ ID NO: 210242 - protein, 10 aa, Borrelia afzelii
PNYPLASSKM

SEQ ID NO: 210243 - protein, 10 aa, Borrelia afzelii
NYPLASSKMR

SEQ ID NO: 210244 - protein, 10 aa, Borrelia afzelii
YPLASSKMRF

SEQ ID NO: 210245 - protein, 10 aa, Borrelia afzelii
PLASSKMRFK

SEQ ID NO: 210246 - protein, 10 aa, Borrelia afzelii
LASSKMRFKA

SEQ ID NO: 210247 - protein, 10 aa, Borrelia afzelii
ASSKMRFKAF

SEQ ID NO: 210248 - protein, 10 aa, Borrelia afzelii
SSKMRFKAFR

SEQ ID NO: 210249 - protein, 10 aa, Borrelia afzelii
SKMRFKAFRV

SEQ ID NO: 210250 - protein, 10 aa, Borrelia afzelii
KMRFKAFRVS

SEQ ID NO: 210251 - protein, 10 aa, Borrelia afzelii
MRFKAFRVSK

SEQ ID NO: 210252 - protein, 10 aa, Borrelia afzelii
RFKAFRVSKS

SEQ ID NO: 210253 - protein, 10 aa, Borrelia afzelii
FKAFRVSKSH

SEQ ID NO: 210254 - protein, 10 aa, Borrelia afzelii
KAFRVSKSHS

SEQ ID NO: 210255 - protein, 10 aa, Borrelia afzelii
AFRVSKSHSS

SEQ ID NO: 210256 - protein, 10 aa, Borrelia afzelii
FRVSKSHSSK

SEQ ID NO: 210257 - protein, 10 aa, Borrelia afzelii
RVSKSHSSKE

SEQ ID NO: 210258 - protein, 10 aa, Borrelia afzelii
VSKSHSSKEQ

SEQ ID NO: 210259 - protein, 10 aa, Borrelia afzelii
SKSHSSKEQN

SEQ ID NO: 210260 - protein, 10 aa, Borrelia afzelii
KSHSSKEQNF

SEQ ID NO: 210261 - protein, 10 aa, Borrelia afzelii
SHSSKEQNFI

SEQ ID NO: 210262 - protein, 10 aa, Borrelia afzelii
HSSKEQNFIF

SEQ ID NO: 210263 - protein, 10 aa, Borrelia afzelii
SSKEQNFIFY

SEQ ID NO: 210264 - protein, 10 aa, Borrelia afzelii
SKEQNFIFYV

SEQ ID NO: 210265 - protein, 10 aa, Borrelia afzelii
KEQNFIFYVK

SEQ ID NO: 210266 - protein, 10 aa, Borrelia afzelii
EQNFIFYVKD

SEQ ID NO: 210267 - protein, 10 aa, Borrelia afzelii
QNFIFYVKDL

SEQ ID NO: 210268 - protein, 10 aa, Borrelia afzelii
NFIFYVKDLR

SEQ ID NO: 210269 - protein, 10 aa, Borrelia afzelii
FIFYVKDLRV

SEQ ID NO: 210270 - protein, 10 aa, Borrelia afzelii
IFYVKDLRVL

SEQ ID NO: 210271 - protein, 10 aa, Borrelia afzelii
FYVKDLRVLY

SEQ ID NO: 210272 - protein, 10 aa, Borrelia afzelii
YVKDLRVLYD

SEQ ID NO: 210273 - protein, 10 aa, Borrelia afzelii
VKDLRVLYDK

SEQ ID NO: 210274 - protein, 10 aa, Borrelia afzelii
KDLRVLYDKL

SEQ ID NO: 210275 - protein, 10 aa, Borrelia afzelii
DLRVLYDKLS

SEQ ID NO: 210276 - protein, 10 aa, Borrelia afzelii
LRVLYDKLSV

SEQ ID NO: 210277 - protein, 10 aa, Borrelia afzelii
RVLYDKLSVS

SEQ ID NO: 210278 - protein, 10 aa, Borrelia afzelii
VLYDKLSVSI

SEQ ID NO: 210279 - protein, 10 aa, Borrelia afzelii
LYDKLSVSID

SEQ ID NO: 210280 - protein, 10 aa, Borrelia afzelii
YDKLSVSIDS

SEQ ID NO: 210281 - protein, 10 aa, Borrelia afzelii
DKLSVSIDSD

SEQ ID NO: 210282 - protein, 10 aa, Borrelia afzelii
KLSVSIDSDI

SEQ ID NO: 210283 - protein, 10 aa, Borrelia afzelii
LSVSIDSDID

SEQ ID NO: 210284 - protein, 10 aa, Borrelia afzelii
SVSIDSDIDS

SEQ ID NO: 210285 - protein, 10 aa, Borrelia afzelii
VSIDSDIDSE

SEQ ID NO: 210286 - protein, 10 aa, Borrelia afzelii
SIDSDIDSES

SEQ ID NO: 210287 - protein, 10 aa, Borrelia afzelii
IDSDIDSESV

SEQ ID NO: 210288 - protein, 10 aa, Borrelia afzelii
DSDIDSESVF

SEQ ID NO: 210289 - protein, 10 aa, Borrelia afzelii
SDIDSESVFK

SEQ ID NO: 210290 - protein, 10 aa, Borrelia afzelii
DIDSESVFKV

SEQ ID NO: 210291 - protein, 10 aa, Borrelia afzelii
IDSESVFKVY

SEQ ID NO: 210292 - protein, 10 aa, Borrelia afzelii
DSESVFKVYE

SEQ ID NO: 210293 - protein, 10 aa, Borrelia afzelii
SESVFKVYET

SEQ ID NO: 210294 - protein, 10 aa, Borrelia afzelii
ESVFKVYETS

SEQ ID NO: 210295 - protein, 10 aa, Borrelia afzelii
SVFKVYETSG

SEQ ID NO: 210296 - protein, 10 aa, Borrelia afzelii
VFKVYETSGA

SEQ ID NO: 210297 - protein, 10 aa, Borrelia afzelii
FKVYETSGAE

SEQ ID NO: 210298 - protein, 10 aa, Borrelia afzelii
KVYETSGAES

SEQ ID NO: 210299 - protein, 10 aa, Borrelia afzelii
VYETSGAESL

SEQ ID NO: 210300 - protein, 10 aa, Borrelia afzelii
YETSGAESLR

SEQ ID NO: 210301 - protein, 10 aa, Borrelia afzelii
ETSGAESLRK

SEQ ID NO: 210302 - protein, 10 aa, Borrelia afzelii
TSGAESLRKL

SEQ ID NO: 210303 - protein, 10 aa, Borrelia afzelii
SGAESLRKLK

SEQ ID NO: 210304 - protein, 10 aa, Borrelia afzelii
GAESLRKLKA

SEQ ID NO: 210305 - protein, 10 aa, Borrelia afzelii
AESLRKLKAH

SEQ ID NO: 210306 - protein, 10 aa, Borrelia afzelii
ESLRKLKAHE

SEQ ID NO: 210307 - protein, 10 aa, Borrelia afzelii
SLRKLKAHET

SEQ ID NO: 210308 - protein, 10 aa, Borrelia afzelii
LRKLKAHETF

SEQ ID NO: 210309 - protein, 10 aa, Borrelia afzelii
RKLKAHETFK

SEQ ID NO: 210310 - protein, 10 aa, Borrelia afzelii
KLKAHETFKR

SEQ ID NO: 210311 - protein, 10 aa, Borrelia afzelii
LKAHETFKRV

SEQ ID NO: 210312 - protein, 10 aa, Borrelia afzelii
KAHETFKRVL

SEQ ID NO: 210313 - protein, 10 aa, Borrelia afzelii
AHETFKRVLK

SEQ ID NO: 210314 - protein, 10 aa, Borrelia afzelii
HETFKRVLKL

SEQ ID NO: 210315 - protein, 10 aa, Borrelia afzelii
ETFKRVLKLR

SEQ ID NO: 210316 - protein, 10 aa, Borrelia afzelii
TFKRVLKLRE

SEQ ID NO: 210317 - protein, 10 aa, Borrelia afzelii
FKRVLKLREK

SEQ ID NO: 210318 - protein, 10 aa, Borrelia afzelii
KRVLKLREKI

SEQ ID NO: 210319 - protein, 10 aa, Borrelia afzelii
RVLKLREKIS

SEQ ID NO: 210320 - protein, 10 aa, Borrelia afzelii
VLKLREKISM

SEQ ID NO: 210321 - protein, 10 aa, Borrelia afzelii
LKLREKISMP

SEQ ID NO: 210322 - protein, 10 aa, Borrelia afzelii
KLREKISMPE

SEQ ID NO: 210323 - protein, 10 aa, Borrelia afzelii
LREKISMPEG

SEQ ID NO: 210324 - protein, 10 aa, Borrelia afzelii
REKISMPEGS

SEQ ID NO: 210325 - protein, 10 aa, Borrelia afzelii
EKISMPEGSF

SEQ ID NO: 210326 - protein, 10 aa, Borrelia afzelii
KISMPEGSFQ

SEQ ID NO: 210327 - protein, 10 aa, Borrelia afzelii
ISMPEGSFQN

SEQ ID NO: 210328 - protein, 10 aa, Borrelia afzelii
SMPEGSFQNF

SEQ ID NO: 210329 - protein, 10 aa, Borrelia afzelii
MPEGSFQNFI

SEQ ID NO: 210330 - protein, 10 aa, Borrelia afzelii
PEGSFQNFIE

SEQ ID NO: 210331 - protein, 10 aa, Borrelia afzelii
EGSFQNFIEK

SEQ ID NO: 210332 - protein, 10 aa, Borrelia afzelii
GSFQNFIEKV

SEQ ID NO: 210333 - protein, 10 aa, Borrelia afzelii
SFQNFIEKVE

SEQ ID NO: 210334 - protein, 10 aa, Borrelia afzelii
FQNFIEKVES

SEQ ID NO: 210335 - protein, 10 aa, Borrelia afzelii
QNFIEKVESD

SEQ ID NO: 210336 - protein, 10 aa, Borrelia afzelii
NFIEKVESDK

SEQ ID NO: 210337 - protein, 10 aa, Borrelia afzelii
FIEKVESDKP

SEQ ID NO: 210338 - protein, 10 aa, Borrelia afzelii
IEKVESDKPE

SEQ ID NO: 210339 - protein, 10 aa, Borrelia afzelii
EKVESDKPEE

SEQ ID NO: 210340 - protein, 10 aa, Borrelia afzelii
KVESDKPEES

SEQ ID NO: 210341 - protein, 10 aa, Borrelia afzelii
VESDKPEESS

SEQ ID NO: 210342 - protein, 10 aa, Borrelia afzelii
ESDKPEESSS

SEQ ID NO: 210343 - protein, 10 aa, Borrelia afzelii
SDKPEESSSE

SEQ ID NO: 210344 - protein, 10 aa, Borrelia afzelii
DKPEESSSEN

SEQ ID NO: 210345 - protein, 11 aa, Borrelia afzelii
MKRKAKSILFF

SEQ ID NO: 210346 - protein, 11 aa, Borrelia afzelii
KRKAKSILFFL

SEQ ID NO: 210347 - protein, 11 aa, Borrelia afzelii
RKAKSILFFLL

SEQ ID NO: 210348 - protein, 11 aa, Borrelia afzelii
KAKSILFFLLS

SEQ ID NO: 210349 - protein, 11 aa, Borrelia afzelii
AKSILFFLLST

SEQ ID NO: 210350 - protein, 11 aa, Borrelia afzelii
KSILFFLLSTA

SEQ ID NO: 210351 - protein, 11 aa, Borrelia afzelii
SILFFLLSTAL

SEQ ID NO: 210352 - protein, 11 aa, Borrelia afzelii
ILFFLLSTALF

SEQ ID NO: 210353 - protein, 11 aa, Borrelia afzelii
LFFLLSTALFA

SEQ ID NO: 210354 - protein, 11 aa, Borrelia afzelii
FFLLSTALFAQ

SEQ ID NO: 210355 - protein, 11 aa, Borrelia afzelii
FLLSTALFAQE

SEQ ID NO: 210356 - protein, 11 aa, Borrelia afzelii
LLSTALFAQET

SEQ ID NO: 210357 - protein, 11 aa, Borrelia afzelii
LSTALFAQETD

SEQ ID NO: 210358 - protein, 11 aa, Borrelia afzelii
STALFAQETDG

SEQ ID NO: 210359 - protein, 11 aa, Borrelia afzelii
TALFAQETDGL

SEQ ID NO: 210360 - protein, 11 aa, Borrelia afzelii
ALFAQETDGLT

SEQ ID NO: 210361 - protein, 11 aa, Borrelia afzelii
LFAQETDGLTE

SEQ ID NO: 210362 - protein, 11 aa, Borrelia afzelii
FAQETDGLTEG

SEQ ID NO: 210363 - protein, 11 aa, Borrelia afzelii
AQETDGLTEGS

SEQ ID NO: 210364 - protein, 11 aa, Borrelia afzelii
QETDGLTEGSK

SEQ ID NO: 210365 - protein, 11 aa, Borrelia afzelii
ETDGLTEGSKR

SEQ ID NO: 210366 - protein, 11 aa, Borrelia afzelii
TDGLTEGSKRA

SEQ ID NO: 210367 - protein, 11 aa, Borrelia afzelii
DGLTEGSKRAE

SEQ ID NO: 210368 - protein, 11 aa, Borrelia afzelii
GLTEGSKRAEP

SEQ ID NO: 210369 - protein, 11 aa, Borrelia afzelii
LTEGSKRAEPG

SEQ ID NO: 210370 - protein, 11 aa, Borrelia afzelii
TEGSKRAEPGE

SEQ ID NO: 210371 - protein, 11 aa, Borrelia afzelii
EGSKRAEPGEL

SEQ ID NO: 210372 - protein, 11 aa, Borrelia afzelii
GSKRAEPGELV

SEQ ID NO: 210373 - protein, 11 aa, Borrelia afzelii
SKRAEPGELVL

SEQ ID NO: 210374 - protein, 11 aa, Borrelia afzelii
KRAEPGELVLD

SEQ ID NO: 210375 - protein, 11 aa, Borrelia afzelii
RAEPGELVLDF

SEQ ID NO: 210376 - protein, 11 aa, Borrelia afzelii
AEPGELVLDFA

SEQ ID NO: 210377 - protein, 11 aa, Borrelia afzelii
EPGELVLDFAE

SEQ ID NO: 210378 - protein, 11 aa, Borrelia afzelii
PGELVLDFAEL

SEQ ID NO: 210379 - protein, 11 aa, Borrelia afzelii
GELVLDFAELA

SEQ ID NO: 210380 - protein, 11 aa, Borrelia afzelii
ELVLDFAELAR

SEQ ID NO: 210381 - protein, 11 aa, Borrelia afzelii
LVLDFAELARD

SEQ ID NO: 210382 - protein, 11 aa, Borrelia afzelii
VLDFAELARDP

SEQ ID NO: 210383 - protein, 11 aa, Borrelia afzelii
LDFAELARDPS

SEQ ID NO: 210384 - protein, 11 aa, Borrelia afzelii
DFAELARDPSS

SEQ ID NO: 210385 - protein, 11 aa, Borrelia afzelii
FAELARDPSST

SEQ ID NO: 210386 - protein, 11 aa, Borrelia afzelii
AELARDPSSTK

SEQ ID NO: 210387 - protein, 11 aa, Borrelia afzelii
ELARDPSSTKL

SEQ ID NO: 210388 - protein, 11 aa, Borrelia afzelii
LARDPSSTKLD

SEQ ID NO: 210389 - protein, 11 aa, Borrelia afzelii
ARDPSSTKLDL

SEQ ID NO: 210390 - protein, 11 aa, Borrelia afzelii
RDPSSTKLDLT

SEQ ID NO: 210391 - protein, 11 aa, Borrelia afzelii
DPSSTKLDLTN

SEQ ID NO: 210392 - protein, 11 aa, Borrelia afzelii
PSSTKLDLTNY

SEQ ID NO: 210393 - protein, 11 aa, Borrelia afzelii
SSTKLDLTNYV

SEQ ID NO: 210394 - protein, 11 aa, Borrelia afzelii
STKLDLTNYVD

SEQ ID NO: 210395 - protein, 11 aa, Borrelia afzelii
TKLDLTNYVDY

SEQ ID NO: 210396 - protein, 11 aa, Borrelia afzelii
KLDLTNYVDYV

SEQ ID NO: 210397 - protein, 11 aa, Borrelia afzelii
LDLTNYVDYVY

SEQ ID NO: 210398 - protein, 11 aa, Borrelia afzelii
DLTNYVDYVYS

SEQ ID NO: 210399 - protein, 11 aa, Borrelia afzelii
LTNYVDYVYSG

SEQ ID NO: 210400 - protein, 11 aa, Borrelia afzelii
TNYVDYVYSGA

SEQ ID NO: 210401 - protein, 11 aa, Borrelia afzelii
NYVDYVYSGAS

SEQ ID NO: 210402 - protein, 11 aa, Borrelia afzelii
YVDYVYSGASG

SEQ ID NO: 210403 - protein, 11 aa, Borrelia afzelii
VDYVYSGASGI

SEQ ID NO: 210404 - protein, 11 aa, Borrelia afzelii
DYVYSGASGIV

SEQ ID NO: 210405 - protein, 11 aa, Borrelia afzelii
YVYSGASGIVK

SEQ ID NO: 210406 - protein, 11 aa, Borrelia afzelii
VYSGASGIVKP

SEQ ID NO: 210407 - protein, 11 aa, Borrelia afzelii
YSGASGIVKPE

SEQ ID NO: 210408 - protein, 11 aa, Borrelia afzelii
SGASGIVKPED

SEQ ID NO: 210409 - protein, 11 aa, Borrelia afzelii
GASGIVKPEDM

SEQ ID NO: 210410 - protein, 11 aa, Borrelia afzelii
ASGIVKPEDMV

SEQ ID NO: 210411 - protein, 11 aa, Borrelia afzelii
SGIVKPEDMVV

SEQ ID NO: 210412 - protein, 11 aa, Borrelia afzelii
GIVKPEDMVVD

SEQ ID NO: 210413 - protein, 11 aa, Borrelia afzelii
IVKPEDMVVDL

SEQ ID NO: 210414 - protein, 11 aa, Borrelia afzelii
VKPEDMVVDLG

SEQ ID NO: 210415 - protein, 11 aa, Borrelia afzelii
KPEDMVVDLGI

SEQ ID NO: 210416 - protein, 11 aa, Borrelia afzelii
PEDMVVDLGIS

SEQ ID NO: 210417 - protein, 11 aa, Borrelia afzelii
EDMVVDLGISN

SEQ ID NO: 210418 - protein, 11 aa, Borrelia afzelii
DMVVDLGISNW

SEQ ID NO: 210419 - protein, 11 aa, Borrelia afzelii
MVVDLGISNWS

SEQ ID NO: 210420 - protein, 11 aa, Borrelia afzelii
VVDLGISNWSV

SEQ ID NO: 210421 - protein, 11 aa, Borrelia afzelii
VDLGISNWSVL

SEQ ID NO: 210422 - protein, 11 aa, Borrelia afzelii
DLGISNWSVLL

SEQ ID NO: 210423 - protein, 11 aa, Borrelia afzelii
LGISNWSVLLT

SEQ ID NO: 210424 - protein, 11 aa, Borrelia afzelii
GISNWSVLLTP

SEQ ID NO: 210425 - protein, 11 aa, Borrelia afzelii
ISNWSVLLTPS

SEQ ID NO: 210426 - protein, 11 aa, Borrelia afzelii
SNWSVLLTPSA

SEQ ID NO: 210427 - protein, 11 aa, Borrelia afzelii
NWSVLLTPSAR

SEQ ID NO: 210428 - protein, 11 aa, Borrelia afzelii
WSVLLTPSARL

SEQ ID NO: 210429 - protein, 11 aa, Borrelia afzelii
SVLLTPSARLQ

SEQ ID NO: 210430 - protein, 11 aa, Borrelia afzelii
VLLTPSARLQA

SEQ ID NO: 210431 - protein, 11 aa, Borrelia afzelii
LLTPSARLQAY

SEQ ID NO: 210432 - protein, 11 aa, Borrelia afzelii
LTPSARLQAYV

SEQ ID NO: 210433 - protein, 11 aa, Borrelia afzelii
TPSARLQAYVK

SEQ ID NO: 210434 - protein, 11 aa, Borrelia afzelii
PSARLQAYVKN

SEQ ID NO: 210435 - protein, 11 aa, Borrelia afzelii
SARLQAYVKNS

SEQ ID NO: 210436 - protein, 11 aa, Borrelia afzelii
ARLQAYVKNSV

SEQ ID NO: 210437 - protein, 11 aa, Borrelia afzelii
RLQAYVKNSVV

SEQ ID NO: 210438 - protein, 11 aa, Borrelia afzelii
LQAYVKNSVVA

SEQ ID NO: 210439 - protein, 11 aa, Borrelia afzelii
QAYVKNSVVAP

SEQ ID NO: 210440 - protein, 11 aa, Borrelia afzelii
AYVKNSVVAPA

SEQ ID NO: 210441 - protein, 11 aa, Borrelia afzelii
YVKNSVVAPAL

SEQ ID NO: 210442 - protein, 11 aa, Borrelia afzelii
VKNSVVAPALV

SEQ ID NO: 210443 - protein, 11 aa, Borrelia afzelii
KNSVVAPALVK

SEQ ID NO: 210444 - protein, 11 aa, Borrelia afzelii
NSVVAPALVKS

SEQ ID NO: 210445 - protein, 11 aa, Borrelia afzelii
SVVAPALVKSE

SEQ ID NO: 210446 - protein, 11 aa, Borrelia afzelii
VVAPALVKSES

SEQ ID NO: 210447 - protein, 11 aa, Borrelia afzelii
VAPALVKSESK

SEQ ID NO: 210448 - protein, 11 aa, Borrelia afzelii
APALVKSESKR

SEQ ID NO: 210449 - protein, 11 aa, Borrelia afzelii
PALVKSESKRY

SEQ ID NO: 210450 - protein, 11 aa, Borrelia afzelii
ALVKSESKRYA

SEQ ID NO: 210451 - protein, 11 aa, Borrelia afzelii
LVKSESKRYAG

SEQ ID NO: 210452 - protein, 11 aa, Borrelia afzelii
VKSESKRYAGD

SEQ ID NO: 210453 - protein, 11 aa, Borrelia afzelii
KSESKRYAGDT

SEQ ID NO: 210454 - protein, 11 aa, Borrelia afzelii
SESKRYAGDTI

SEQ ID NO: 210455 - protein, 11 aa, Borrelia afzelii
ESKRYAGDTIL

SEQ ID NO: 210456 - protein, 11 aa, Borrelia afzelii
SKRYAGDTILG

SEQ ID NO: 210457 - protein, 11 aa, Borrelia afzelii
KRYAGDTILGV

SEQ ID NO: 210458 - protein, 11 aa, Borrelia afzelii
RYAGDTILGVR

SEQ ID NO: 210459 - protein, 11 aa, Borrelia afzelii
YAGDTILGVRV

SEQ ID NO: 210460 - protein, 11 aa, Borrelia afzelii
AGDTILGVRVL

SEQ ID NO: 210461 - protein, 11 aa, Borrelia afzelii
GDTILGVRVLF

SEQ ID NO: 210462 - protein, 11 aa, Borrelia afzelii
DTILGVRVLFP

SEQ ID NO: 210463 - protein, 11 aa, Borrelia afzelii
TILGVRVLFPS

SEQ ID NO: 210464 - protein, 11 aa, Borrelia afzelii
ILGVRVLFPSY

SEQ ID NO: 210465 - protein, 11 aa, Borrelia afzelii
LGVRVLFPSYS

SEQ ID NO: 210466 - protein, 11 aa, Borrelia afzelii
GVRVLFPSYSQ

SEQ ID NO: 210467 - protein, 11 aa, Borrelia afzelii
VRVLFPSYSQS

SEQ ID NO: 210468 - protein, 11 aa, Borrelia afzelii
RVLFPSYSQSS

SEQ ID NO: 210469 - protein, 11 aa, Borrelia afzelii
VLFPSYSQSSA

SEQ ID NO: 210470 - protein, 11 aa, Borrelia afzelii
LFPSYSQSSAM

SEQ ID NO: 210471 - protein, 11 aa, Borrelia afzelii
FPSYSQSSAMI

SEQ ID NO: 210472 - protein, 11 aa, Borrelia afzelii
PSYSQSSAMIM

SEQ ID NO: 210473 - protein, 11 aa, Borrelia afzelii
SYSQSSAMIMP

SEQ ID NO: 210474 - protein, 11 aa, Borrelia afzelii
YSQSSAMIMPP

SEQ ID NO: 210475 - protein, 11 aa, Borrelia afzelii
SQSSAMIMPPF

SEQ ID NO: 210476 - protein, 11 aa, Borrelia afzelii
QSSAMIMPPFK

SEQ ID NO: 210477 - protein, 11 aa, Borrelia afzelii
SSAMIMPPFKI

SEQ ID NO: 210478 - protein, 11 aa, Borrelia afzelii
SAMIMPPFKIP

SEQ ID NO: 210479 - protein, 11 aa, Borrelia afzelii
AMIMPPFKIPF

SEQ ID NO: 210480 - protein, 11 aa, Borrelia afzelii
MIMPPFKIPFY

SEQ ID NO: 210481 - protein, 11 aa, Borrelia afzelii
IMPPFKIPFYS

SEQ ID NO: 210482 - protein, 11 aa, Borrelia afzelii
MPPFKIPFYSG

SEQ ID NO: 210483 - protein, 11 aa, Borrelia afzelii
PPFKIPFYSGE

SEQ ID NO: 210484 - protein, 11 aa, Borrelia afzelii
PFKIPFYSGES

SEQ ID NO: 210485 - protein, 11 aa, Borrelia afzelii
FKIPFYSGESG

SEQ ID NO: 210486 - protein, 11 aa, Borrelia afzelii
KIPFYSGESGN

SEQ ID NO: 210487 - protein, 11 aa, Borrelia afzelii
IPFYSGESGNQ

SEQ ID NO: 210488 - protein, 11 aa, Borrelia afzelii
PFYSGESGNQF

SEQ ID NO: 210489 - protein, 11 aa, Borrelia afzelii
FYSGESGNQFL

SEQ ID NO: 210490 - protein, 11 aa, Borrelia afzelii
YSGESGNQFLG

SEQ ID NO: 210491 - protein, 11 aa, Borrelia afzelii
SGESGNQFLGK

SEQ ID NO: 210492 - protein, 11 aa, Borrelia afzelii
GESGNQFLGKG

SEQ ID NO: 210493 - protein, 11 aa, Borrelia afzelii
ESGNQFLGKGL

SEQ ID NO: 210494 - protein, 11 aa, Borrelia afzelii
SGNQFLGKGLI

SEQ ID NO: 210495 - protein, 11 aa, Borrelia afzelii
GNQFLGKGLID

SEQ ID NO: 210496 - protein, 11 aa, Borrelia afzelii
NQFLGKGLIDN

SEQ ID NO: 210497 - protein, 11 aa, Borrelia afzelii
QFLGKGLIDNI

SEQ ID NO: 210498 - protein, 11 aa, Borrelia afzelii
FLGKGLIDNIK

SEQ ID NO: 210499 - protein, 11 aa, Borrelia afzelii
LGKGLIDNIKT

SEQ ID NO: 210500 - protein, 11 aa, Borrelia afzelii
GKGLIDNIKTM

SEQ ID NO: 210501 - protein, 11 aa, Borrelia afzelii
KGLIDNIKTMK

SEQ ID NO: 210502 - protein, 11 aa, Borrelia afzelii
GLIDNIKTMKE

SEQ ID NO: 210503 - protein, 11 aa, Borrelia afzelii
LIDNIKTMKEI

SEQ ID NO: 210504 - protein, 11 aa, Borrelia afzelii
IDNIKTMKEIK

SEQ ID NO: 210505 - protein, 11 aa, Borrelia afzelii
DNIKTMKEIKV

SEQ ID NO: 210506 - protein, 11 aa, Borrelia afzelii
NIKTMKEIKVS

SEQ ID NO: 210507 - protein, 11 aa, Borrelia afzelii
IKTMKEIKVSV

SEQ ID NO: 210508 - protein, 11 aa, Borrelia afzelii
KTMKEIKVSVY

SEQ ID NO: 210509 - protein, 11 aa, Borrelia afzelii
TMKEIKVSVYS

SEQ ID NO: 210510 - protein, 11 aa, Borrelia afzelii
MKEIKVSVYSL

SEQ ID NO: 210511 - protein, 11 aa, Borrelia afzelii
KEIKVSVYSLG

SEQ ID NO: 210512 - protein, 11 aa, Borrelia afzelii
EIKVSVYSLGY

SEQ ID NO: 210513 - protein, 11 aa, Borrelia afzelii
IKVSVYSLGYE

SEQ ID NO: 210514 - protein, 11 aa, Borrelia afzelii
KVSVYSLGYEV

SEQ ID NO: 210515 - protein, 11 aa, Borrelia afzelii
VSVYSLGYEVD

SEQ ID NO: 210516 - protein, 11 aa, Borrelia afzelii
SVYSLGYEVDL

SEQ ID NO: 210517 - protein, 11 aa, Borrelia afzelii
VYSLGYEVDLE

SEQ ID NO: 210518 - protein, 11 aa, Borrelia afzelii
YSLGYEVDLEV

SEQ ID NO: 210519 - protein, 11 aa, Borrelia afzelii
SLGYEVDLEVL

SEQ ID NO: 210520 - protein, 11 aa, Borrelia afzelii
LGYEVDLEVLF

SEQ ID NO: 210521 - protein, 11 aa, Borrelia afzelii
GYEVDLEVLFE

SEQ ID NO: 210522 - protein, 11 aa, Borrelia afzelii
YEVDLEVLFED

SEQ ID NO: 210523 - protein, 11 aa, Borrelia afzelii
EVDLEVLFEDM

SEQ ID NO: 210524 - protein, 11 aa, Borrelia afzelii
VDLEVLFEDMN

SEQ ID NO: 210525 - protein, 11 aa, Borrelia afzelii
DLEVLFEDMNG

SEQ ID NO: 210526 - protein, 11 aa, Borrelia afzelii
LEVLFEDMNGM

SEQ ID NO: 210527 - protein, 11 aa, Borrelia afzelii
EVLFEDMNGME

SEQ ID NO: 210528 - protein, 11 aa, Borrelia afzelii
VLFEDMNGMEY

SEQ ID NO: 210529 - protein, 11 aa, Borrelia afzelii
LFEDMNGMEYA

SEQ ID NO: 210530 - protein, 11 aa, Borrelia afzelii
FEDMNGMEYAY

SEQ ID NO: 210531 - protein, 11 aa, Borrelia afzelii
EDMNGMEYAYS

SEQ ID NO: 210532 - protein, 11 aa, Borrelia afzelii
DMNGMEYAYSL

SEQ ID NO: 210533 - protein, 11 aa, Borrelia afzelii
MNGMEYAYSLG

SEQ ID NO: 210534 - protein, 11 aa, Borrelia afzelii
NGMEYAYSLGT

SEQ ID NO: 210535 - protein, 11 aa, Borrelia afzelii
GMEYAYSLGTL

SEQ ID NO: 210536 - protein, 11 aa, Borrelia afzelii
MEYAYSLGTLK

SEQ ID NO: 210537 - protein, 11 aa, Borrelia afzelii
EYAYSLGTLKF

SEQ ID NO: 210538 - protein, 11 aa, Borrelia afzelii
YAYSLGTLKFK

SEQ ID NO: 210539 - protein, 11 aa, Borrelia afzelii
AYSLGTLKFKG

SEQ ID NO: 210540 - protein, 11 aa, Borrelia afzelii
YSLGTLKFKGW

SEQ ID NO: 210541 - protein, 11 aa, Borrelia afzelii
SLGTLKFKGWA

SEQ ID NO: 210542 - protein, 11 aa, Borrelia afzelii
LGTLKFKGWAD

SEQ ID NO: 210543 - protein, 11 aa, Borrelia afzelii
GTLKFKGWADL

SEQ ID NO: 210544 - protein, 11 aa, Borrelia afzelii
TLKFKGWADLI

SEQ ID NO: 210545 - protein, 11 aa, Borrelia afzelii
LKFKGWADLIW

SEQ ID NO: 210546 - protein, 11 aa, Borrelia afzelii
KFKGWADLIWS

SEQ ID NO: 210547 - protein, 11 aa, Borrelia afzelii
FKGWADLIWSN

SEQ ID NO: 210548 - protein, 11 aa, Borrelia afzelii
KGWADLIWSNP

SEQ ID NO: 210549 - protein, 11 aa, Borrelia afzelii
GWADLIWSNPN

SEQ ID NO: 210550 - protein, 11 aa, Borrelia afzelii
WADLIWSNPNY

SEQ ID NO: 210551 - protein, 11 aa, Borrelia afzelii
ADLIWSNPNYI

SEQ ID NO: 210552 - protein, 11 aa, Borrelia afzelii
DLIWSNPNYIP

SEQ ID NO: 210553 - protein, 11 aa, Borrelia afzelii
LIWSNPNYIPN

SEQ ID NO: 210554 - protein, 11 aa, Borrelia afzelii
IWSNPNYIPNI

SEQ ID NO: 210555 - protein, 11 aa, Borrelia afzelii
WSNPNYIPNIS

SEQ ID NO: 210556 - protein, 11 aa, Borrelia afzelii
SNPNYIPNISA

SEQ ID NO: 210557 - protein, 11 aa, Borrelia afzelii
NPNYIPNISAR

SEQ ID NO: 210558 - protein, 11 aa, Borrelia afzelii
PNYIPNISARI

SEQ ID NO: 210559 - protein, 11 aa, Borrelia afzelii
NYIPNISARII

SEQ ID NO: 210560 - protein, 11 aa, Borrelia afzelii
YIPNISARIIK

SEQ ID NO: 210561 - protein, 11 aa, Borrelia afzelii
IPNISARIIKD

SEQ ID NO: 210562 - protein, 11 aa, Borrelia afzelii
PNISARIIKDD

SEQ ID NO: 210563 - protein, 11 aa, Borrelia afzelii
NISARIIKDDV

SEQ ID NO: 210564 - protein, 11 aa, Borrelia afzelii
ISARIIKDDVP

SEQ ID NO: 210565 - protein, 11 aa, Borrelia afzelii
SARIIKDDVPN

SEQ ID NO: 210566 - protein, 11 aa, Borrelia afzelii
ARIIKDDVPNY

SEQ ID NO: 210567 - protein, 11 aa, Borrelia afzelii
RIIKDDVPNYP

SEQ ID NO: 210568 - protein, 11 aa, Borrelia afzelii
IIKDDVPNYPL

SEQ ID NO: 210569 - protein, 11 aa, Borrelia afzelii
IKDDVPNYPLA

SEQ ID NO: 210570 - protein, 11 aa, Borrelia afzelii
KDDVPNYPLAS

SEQ ID NO: 210571 - protein, 11 aa, Borrelia afzelii
DDVPNYPLASS

SEQ ID NO: 210572 - protein, 11 aa, Borrelia afzelii
DVPNYPLASSK

SEQ ID NO: 210573 - protein, 11 aa, Borrelia afzelii
VPNYPLASSKM

SEQ ID NO: 210574 - protein, 11 aa, Borrelia afzelii
PNYPLASSKMR

SEQ ID NO: 210575 - protein, 11 aa, Borrelia afzelii
NYPLASSKMRF

SEQ ID NO: 210576 - protein, 11 aa, Borrelia afzelii
YPLASSKMRFK

SEQ ID NO: 210577 - protein, 11 aa, Borrelia afzelii
PLASSKMRFKA

SEQ ID NO: 210578 - protein, 11 aa, Borrelia afzelii
LASSKMRFKAF

SEQ ID NO: 210579 - protein, 11 aa, Borrelia afzelii
ASSKMRFKAFR

SEQ ID NO: 210580 - protein, 11 aa, Borrelia afzelii
SSKMRFKAFRV

SEQ ID NO: 210581 - protein, 11 aa, Borrelia afzelii
SKMRFKAFRVS

SEQ ID NO: 210582 - protein, 11 aa, Borrelia afzelii
KMRFKAFRVSK

SEQ ID NO: 210583 - protein, 11 aa, Borrelia afzelii
MRFKAFRVSKS

SEQ ID NO: 210584 - protein, 11 aa, Borrelia afzelii
RFKAFRVSKSH

SEQ ID NO: 210585 - protein, 11 aa, Borrelia afzelii
FKAFRVSKSHS

SEQ ID NO: 210586 - protein, 11 aa, Borrelia afzelii
KAFRVSKSHSS

SEQ ID NO: 210587 - protein, 11 aa, Borrelia afzelii
AFRVSKSHSSK

SEQ ID NO: 210588 - protein, 11 aa, Borrelia afzelii
FRVSKSHSSKE

SEQ ID NO: 210589 - protein, 11 aa, Borrelia afzelii
RVSKSHSSKEQ

SEQ ID NO: 210590 - protein, 11 aa, Borrelia afzelii
VSKSHSSKEQN

SEQ ID NO: 210591 - protein, 11 aa, Borrelia afzelii
SKSHSSKEQNF

SEQ ID NO: 210592 - protein, 11 aa, Borrelia afzelii
KSHSSKEQNFI

SEQ ID NO: 210593 - protein, 11 aa, Borrelia afzelii
SHSSKEQNFIF

SEQ ID NO: 210594 - protein, 11 aa, Borrelia afzelii
HSSKEQNFIFY

SEQ ID NO: 210595 - protein, 11 aa, Borrelia afzelii
SSKEQNFIFYV

SEQ ID NO: 210596 - protein, 11 aa, Borrelia afzelii
SKEQNFIFYVK

SEQ ID NO: 210597 - protein, 11 aa, Borrelia afzelii
KEQNFIFYVKD

SEQ ID NO: 210598 - protein, 11 aa, Borrelia afzelii
EQNFIFYVKDL

SEQ ID NO: 210599 - protein, 11 aa, Borrelia afzelii
QNFIFYVKDLR

SEQ ID NO: 210600 - protein, 11 aa, Borrelia afzelii
NFIFYVKDLRV

SEQ ID NO: 210601 - protein, 11 aa, Borrelia afzelii
FIFYVKDLRVL

SEQ ID NO: 210602 - protein, 11 aa, Borrelia afzelii
IFYVKDLRVLY

SEQ ID NO: 210603 - protein, 11 aa, Borrelia afzelii
FYVKDLRVLYD

SEQ ID NO: 210604 - protein, 11 aa, Borrelia afzelii
YVKDLRVLYDK

SEQ ID NO: 210605 - protein, 11 aa, Borrelia afzelii
VKDLRVLYDKL

SEQ ID NO: 210606 - protein, 11 aa, Borrelia afzelii
KDLRVLYDKLS

SEQ ID NO: 210607 - protein, 11 aa, Borrelia afzelii
DLRVLYDKLSV

SEQ ID NO: 210608 - protein, 11 aa, Borrelia afzelii
LRVLYDKLSVS

SEQ ID NO: 210609 - protein, 11 aa, Borrelia afzelii
RVLYDKLSVSI

SEQ ID NO: 210610 - protein, 11 aa, Borrelia afzelii
VLYDKLSVSID

SEQ ID NO: 210611 - protein, 11 aa, Borrelia afzelii
LYDKLSVSIDS

SEQ ID NO: 210612 - protein, 11 aa, Borrelia afzelii
YDKLSVSIDSD

SEQ ID NO: 210613 - protein, 11 aa, Borrelia afzelii
DKLSVSIDSDI

SEQ ID NO: 210614 - protein, 11 aa, Borrelia afzelii
KLSVSIDSDID

SEQ ID NO: 210615 - protein, 11 aa, Borrelia afzelii
LSVSIDSDIDS

SEQ ID NO: 210616 - protein, 11 aa, Borrelia afzelii
SVSIDSDIDSE

SEQ ID NO: 210617 - protein, 11 aa, Borrelia afzelii
VSIDSDIDSES

SEQ ID NO: 210618 - protein, 11 aa, Borrelia afzelii
SIDSDIDSESV

SEQ ID NO: 210619 - protein, 11 aa, Borrelia afzelii
IDSDIDSESVF

SEQ ID NO: 210620 - protein, 11 aa, Borrelia afzelii
DSDIDSESVFK

SEQ ID NO: 210621 - protein, 11 aa, Borrelia afzelii
SDIDSESVFKV

SEQ ID NO: 210622 - protein, 11 aa, Borrelia afzelii
DIDSESVFKVY

SEQ ID NO: 210623 - protein, 11 aa, Borrelia afzelii
IDSESVFKVYE

SEQ ID NO: 210624 - protein, 11 aa, Borrelia afzelii
DSESVFKVYET

SEQ ID NO: 210625 - protein, 11 aa, Borrelia afzelii
SESVFKVYETS

SEQ ID NO: 210626 - protein, 11 aa, Borrelia afzelii
ESVFKVYETSG

SEQ ID NO: 210627 - protein, 11 aa, Borrelia afzelii
SVFKVYETSGA

SEQ ID NO: 210628 - protein, 11 aa, Borrelia afzelii
VFKVYETSGAE

SEQ ID NO: 210629 - protein, 11 aa, Borrelia afzelii
FKVYETSGAES

SEQ ID NO: 210630 - protein, 11 aa, Borrelia afzelii
KVYETSGAESL

SEQ ID NO: 210631 - protein, 11 aa, Borrelia afzelii
VYETSGAESLR

SEQ ID NO: 210632 - protein, 11 aa, Borrelia afzelii
YETSGAESLRK

SEQ ID NO: 210633 - protein, 11 aa, Borrelia afzelii
ETSGAESLRKL

SEQ ID NO: 210634 - protein, 11 aa, Borrelia afzelii
TSGAESLRKLK

SEQ ID NO: 210635 - protein, 11 aa, Borrelia afzelii
SGAESLRKLKA

SEQ ID NO: 210636 - protein, 11 aa, Borrelia afzelii
GAESLRKLKAH

SEQ ID NO: 210637 - protein, 11 aa, Borrelia afzelii
AESLRKLKAHE

SEQ ID NO: 210638 - protein, 11 aa, Borrelia afzelii
ESLRKLKAHET

SEQ ID NO: 210639 - protein, 11 aa, Borrelia afzelii
SLRKLKAHETF

SEQ ID NO: 210640 - protein, 11 aa, Borrelia afzelii
LRKLKAHETFK

SEQ ID NO: 210641 - protein, 11 aa, Borrelia afzelii
RKLKAHETFKR

SEQ ID NO: 210642 - protein, 11 aa, Borrelia afzelii
KLKAHETFKRV

SEQ ID NO: 210643 - protein, 11 aa, Borrelia afzelii
LKAHETFKRVL

SEQ ID NO: 210644 - protein, 11 aa, Borrelia afzelii
KAHETFKRVLK

SEQ ID NO: 210645 - protein, 11 aa, Borrelia afzelii
AHETFKRVLKL

SEQ ID NO: 210646 - protein, 11 aa, Borrelia afzelii
HETFKRVLKLR

SEQ ID NO: 210647 - protein, 11 aa, Borrelia afzelii
ETFKRVLKLRE

SEQ ID NO: 210648 - protein, 11 aa, Borrelia afzelii
TFKRVLKLREK

SEQ ID NO: 210649 - protein, 11 aa, Borrelia afzelii
FKRVLKLREKI

SEQ ID NO: 210650 - protein, 11 aa, Borrelia afzelii
KRVLKLREKIS

SEQ ID NO: 210651 - protein, 11 aa, Borrelia afzelii
RVLKLREKISM

SEQ ID NO: 210652 - protein, 11 aa, Borrelia afzelii
VLKLREKISMP

SEQ ID NO: 210653 - protein, 11 aa, Borrelia afzelii
LKLREKISMPE

SEQ ID NO: 210654 - protein, 11 aa, Borrelia afzelii
KLREKISMPEG

SEQ ID NO: 210655 - protein, 11 aa, Borrelia afzelii
LREKISMPEGS

SEQ ID NO: 210656 - protein, 11 aa, Borrelia afzelii
REKISMPEGSF

SEQ ID NO: 210657 - protein, 11 aa, Borrelia afzelii
EKISMPEGSFQ

SEQ ID NO: 210658 - protein, 11 aa, Borrelia afzelii
KISMPEGSFQN

SEQ ID NO: 210659 - protein, 11 aa, Borrelia afzelii
ISMPEGSFQNF

SEQ ID NO: 210660 - protein, 11 aa, Borrelia afzelii
SMPEGSFQNFI

SEQ ID NO: 210661 - protein, 11 aa, Borrelia afzelii
MPEGSFQNFIE

SEQ ID NO: 210662 - protein, 11 aa, Borrelia afzelii
PEGSFQNFIEK

SEQ ID NO: 210663 - protein, 11 aa, Borrelia afzelii
EGSFQNFIEKV

SEQ ID NO: 210664 - protein, 11 aa, Borrelia afzelii
GSFQNFIEKVE

SEQ ID NO: 210665 - protein, 11 aa, Borrelia afzelii
SFQNFIEKVES

SEQ ID NO: 210666 - protein, 11 aa, Borrelia afzelii
FQNFIEKVESD

SEQ ID NO: 210667 - protein, 11 aa, Borrelia afzelii
QNFIEKVESDK

SEQ ID NO: 210668 - protein, 11 aa, Borrelia afzelii
NFIEKVESDKP

SEQ ID NO: 210669 - protein, 11 aa, Borrelia afzelii
FIEKVESDKPE

SEQ ID NO: 210670 - protein, 11 aa, Borrelia afzelii
IEKVESDKPEE

SEQ ID NO: 210671 - protein, 11 aa, Borrelia afzelii
EKVESDKPEES

SEQ ID NO: 210672 - protein, 11 aa, Borrelia afzelii
KVESDKPEESS

SEQ ID NO: 210673 - protein, 11 aa, Borrelia afzelii
VESDKPEESSS

SEQ ID NO: 210674 - protein, 11 aa, Borrelia afzelii
ESDKPEESSSE

SEQ ID NO: 210675 - protein, 11 aa, Borrelia afzelii
SDKPEESSSEN

SEQ ID NO: 210676 - protein, 342 aa, Borrelia garinii
MKRKAKSILLFLLSTALFAQETDGLPEGSKRSEPGELVLDFAELARDPSSTKLDLTNYVDYVYSGASGIVKPEDMVVDLGINNWSVLLTPSARLQAYVKNSVVAPAVVKSESKRYAGDTILGVRVLFPSYSQSSAMIMPPFKIPFYSGENGNQFLGKGLINNIKTMKEIKVSVYSLGYEIDLEVLFEDMNGMEYAYSLGTLKFKGWADLIWSNPNYIPNISSRIIKDDVPNYPLASSKMRFKAFRVSKSHSSKEQNFIFYVKDLRVLYDKLSVSIDSDIDSESVFKVYETSGTESLRKLKAHETFKRVLKLREKISMPEGSFQNFIEKVESEKKPEESSLKK

SEQ ID NO: 210677 - protein, 8 aa, Borrelia garinii
MKRKAKSI

SEQ ID NO: 210678 - protein, 8 aa, Borrelia garinii
KRKAKSIL

SEQ ID NO: 210679 - protein, 8 aa, Borrelia garinii
RKAKSILL

SEQ ID NO: 210680 - protein, 8 aa, Borrelia garinii
KAKSILLF

SEQ ID NO: 210681 - protein, 8 aa, Borrelia garinii
AKSILLFL

SEQ ID NO: 210682 - protein, 8 aa, Borrelia garinii
KSILLFLL

SEQ ID NO: 210683 - protein, 8 aa, Borrelia garinii
SILLFLLS

SEQ ID NO: 210684 - protein, 8 aa, Borrelia garinii
ILLFLLST

SEQ ID NO: 210685 - protein, 8 aa, Borrelia garinii
LLFLLSTA

SEQ ID NO: 210686 - protein, 8 aa, Borrelia garinii
LFLLSTAL

SEQ ID NO: 210687 - protein, 8 aa, Borrelia garinii
FLLSTALF

SEQ ID NO: 210688 - protein, 8 aa, Borrelia garinii
LLSTALFA

SEQ ID NO: 210689 - protein, 8 aa, Borrelia garinii
LSTALFAQ

SEQ ID NO: 210690 - protein, 8 aa, Borrelia garinii
STALFAQE

SEQ ID NO: 210691 - protein, 8 aa, Borrelia garinii
TALFAQET

SEQ ID NO: 210692 - protein, 8 aa, Borrelia garinii
ALFAQETD

SEQ ID NO: 210693 - protein, 8 aa, Borrelia garinii
LFAQETDG

SEQ ID NO: 210694 - protein, 8 aa, Borrelia garinii
FAQETDGL

SEQ ID NO: 210695 - protein, 8 aa, Borrelia garinii
AQETDGLP

SEQ ID NO: 210696 - protein, 8 aa, Borrelia garinii
QETDGLPE

SEQ ID NO: 210697 - protein, 8 aa, Borrelia garinii
ETDGLPEG

SEQ ID NO: 210698 - protein, 8 aa, Borrelia garinii
TDGLPEGS

SEQ ID NO: 210699 - protein, 8 aa, Borrelia garinii
DGLPEGSK

SEQ ID NO: 210700 - protein, 8 aa, Borrelia garinii
GLPEGSKR

SEQ ID NO: 210701 - protein, 8 aa, Borrelia garinii
LPEGSKRS

SEQ ID NO: 210702 - protein, 8 aa, Borrelia garinii
PEGSKRSE

SEQ ID NO: 210703 - protein, 8 aa, Borrelia garinii
EGSKRSEP

SEQ ID NO: 210704 - protein, 8 aa, Borrelia garinii
GSKRSEPG

SEQ ID NO: 210705 - protein, 8 aa, Borrelia garinii
SKRSEPGE

SEQ ID NO: 210706 - protein, 8 aa, Borrelia garinii
KRSEPGEL

SEQ ID NO: 210707 - protein, 8 aa, Borrelia garinii
RSEPGELV

SEQ ID NO: 210708 - protein, 8 aa, Borrelia garinii
SEPGELVL

SEQ ID NO: 210709 - protein, 8 aa, Borrelia garinii
EPGELVLD

SEQ ID NO: 210710 - protein, 8 aa, Borrelia garinii
PGELVLDF

SEQ ID NO: 210711 - protein, 8 aa, Borrelia garinii
GELVLDFA

SEQ ID NO: 210712 - protein, 8 aa, Borrelia garinii
ELVLDFAE

SEQ ID NO: 210713 - protein, 8 aa, Borrelia garinii
LVLDFAEL

SEQ ID NO: 210714 - protein, 8 aa, Borrelia garinii
VLDFAELA

SEQ ID NO: 210715 - protein, 8 aa, Borrelia garinii
LDFAELAR

SEQ ID NO: 210716 - protein, 8 aa, Borrelia garinii
DFAELARD

SEQ ID NO: 210717 - protein, 8 aa, Borrelia garinii
FAELARDP

SEQ ID NO: 210718 - protein, 8 aa, Borrelia garinii
AELARDPS

SEQ ID NO: 210719 - protein, 8 aa, Borrelia garinii
ELARDPSS

SEQ ID NO: 210720 - protein, 8 aa, Borrelia garinii
LARDPSST

SEQ ID NO: 210721 - protein, 8 aa, Borrelia garinii
ARDPSSTK

SEQ ID NO: 210722 - protein, 8 aa, Borrelia garinii
RDPSSTKL

SEQ ID NO: 210723 - protein, 8 aa, Borrelia garinii
DPSSTKLD

SEQ ID NO: 210724 - protein, 8 aa, Borrelia garinii
PSSTKLDL

SEQ ID NO: 210725 - protein, 8 aa, Borrelia garinii
SSTKLDLT

SEQ ID NO: 210726 - protein, 8 aa, Borrelia garinii
STKLDLTN

SEQ ID NO: 210727 - protein, 8 aa, Borrelia garinii
TKLDLTNY

SEQ ID NO: 210728 - protein, 8 aa, Borrelia garinii
KLDLTNYV

SEQ ID NO: 210729 - protein, 8 aa, Borrelia garinii
LDLTNYVD

SEQ ID NO: 210730 - protein, 8 aa, Borrelia garinii
DLTNYVDY

SEQ ID NO: 210731 - protein, 8 aa, Borrelia garinii
LTNYVDYV

SEQ ID NO: 210732 - protein, 8 aa, Borrelia garinii
TNYVDYVY

SEQ ID NO: 210733 - protein, 8 aa, Borrelia garinii
NYVDYVYS

SEQ ID NO: 210734 - protein, 8 aa, Borrelia garinii
YVDYVYSG

SEQ ID NO: 210735 - protein, 8 aa, Borrelia garinii
VDYVYSGA

SEQ ID NO: 210736 - protein, 8 aa, Borrelia garinii
DYVYSGAS

SEQ ID NO: 210737 - protein, 8 aa, Borrelia garinii
YVYSGASG

SEQ ID NO: 210738 - protein, 8 aa, Borrelia garinii
VYSGASGI

SEQ ID NO: 210739 - protein, 8 aa, Borrelia garinii
YSGASGIV

SEQ ID NO: 210740 - protein, 8 aa, Borrelia garinii
SGASGIVK

SEQ ID NO: 210741 - protein, 8 aa, Borrelia garinii
GASGIVKP

SEQ ID NO: 210742 - protein, 8 aa, Borrelia garinii
ASGIVKPE

SEQ ID NO: 210743 - protein, 8 aa, Borrelia garinii
SGIVKPED

SEQ ID NO: 210744 - protein, 8 aa, Borrelia garinii
GIVKPEDM

SEQ ID NO: 210745 - protein, 8 aa, Borrelia garinii
IVKPEDMV

SEQ ID NO: 210746 - protein, 8 aa, Borrelia garinii
VKPEDMVV

SEQ ID NO: 210747 - protein, 8 aa, Borrelia garinii
KPEDMVVD

SEQ ID NO: 210748 - protein, 8 aa, Borrelia garinii
PEDMVVDL

SEQ ID NO: 210749 - protein, 8 aa, Borrelia garinii
EDMVVDLG

SEQ ID NO: 210750 - protein, 8 aa, Borrelia garinii
DMVVDLGI

SEQ ID NO: 210751 - protein, 8 aa, Borrelia garinii
MVVDLGIN

SEQ ID NO: 210752 - protein, 8 aa, Borrelia garinii
VVDLGINN

SEQ ID NO: 210753 - protein, 8 aa, Borrelia garinii
VDLGINNW

SEQ ID NO: 210754 - protein, 8 aa, Borrelia garinii
DLGINNWS

SEQ ID NO: 210755 - protein, 8 aa, Borrelia garinii
LGINNWSV

SEQ ID NO: 210756 - protein, 8 aa, Borrelia garinii
GINNWSVL

SEQ ID NO: 210757 - protein, 8 aa, Borrelia garinii
INNWSVLL

SEQ ID NO: 210758 - protein, 8 aa, Borrelia garinii
NNWSVLLT

SEQ ID NO: 210759 - protein, 8 aa, Borrelia garinii
NWSVLLTP

SEQ ID NO: 210760 - protein, 8 aa, Borrelia garinii
WSVLLTPS

SEQ ID NO: 210761 - protein, 8 aa, Borrelia garinii
SVLLTPSA

SEQ ID NO: 210762 - protein, 8 aa, Borrelia garinii
VLLTPSAR

SEQ ID NO: 210763 - protein, 8 aa, Borrelia garinii
LLTPSARL

SEQ ID NO: 210764 - protein, 8 aa, Borrelia garinii
LTPSARLQ

SEQ ID NO: 210765 - protein, 8 aa, Borrelia garinii
TPSARLQA

SEQ ID NO: 210766 - protein, 8 aa, Borrelia garinii
PSARLQAY

SEQ ID NO: 210767 - protein, 8 aa, Borrelia garinii
SARLQAYV

SEQ ID NO: 210768 - protein, 8 aa, Borrelia garinii
ARLQAYVK

SEQ ID NO: 210769 - protein, 8 aa, Borrelia garinii
RLQAYVKN

SEQ ID NO: 210770 - protein, 8 aa, Borrelia garinii
LQAYVKNS

SEQ ID NO: 210771 - protein, 8 aa, Borrelia garinii
QAYVKNSV

SEQ ID NO: 210772 - protein, 8 aa, Borrelia garinii
AYVKNSVV

SEQ ID NO: 210773 - protein, 8 aa, Borrelia garinii
YVKNSVVA

SEQ ID NO: 210774 - protein, 8 aa, Borrelia garinii
VKNSVVAP

SEQ ID NO: 210775 - protein, 8 aa, Borrelia garinii
KNSVVAPA

SEQ ID NO: 210776 - protein, 8 aa, Borrelia garinii
NSVVAPAV

SEQ ID NO: 210777 - protein, 8 aa, Borrelia garinii
SVVAPAVV

SEQ ID NO: 210778 - protein, 8 aa, Borrelia garinii
VVAPAVVK

SEQ ID NO: 210779 - protein, 8 aa, Borrelia garinii
VAPAVVKS

SEQ ID NO: 210780 - protein, 8 aa, Borrelia garinii
APAVVKSE

SEQ ID NO: 210781 - protein, 8 aa, Borrelia garinii
PAVVKSES

SEQ ID NO: 210782 - protein, 8 aa, Borrelia garinii
AVVKSESK

SEQ ID NO: 210783 - protein, 8 aa, Borrelia garinii
VVKSESKR

SEQ ID NO: 210784 - protein, 8 aa, Borrelia garinii
VKSESKRY

SEQ ID NO: 210785 - protein, 8 aa, Borrelia garinii
KSESKRYA

SEQ ID NO: 210786 - protein, 8 aa, Borrelia garinii
SESKRYAG

SEQ ID NO: 210787 - protein, 8 aa, Borrelia garinii
ESKRYAGD

SEQ ID NO: 210788 - protein, 8 aa, Borrelia garinii
SKRYAGDT

SEQ ID NO: 210789 - protein, 8 aa, Borrelia garinii
KRYAGDTI

SEQ ID NO: 210790 - protein, 8 aa, Borrelia garinii
RYAGDTIL

SEQ ID NO: 210791 - protein, 8 aa, Borrelia garinii
YAGDTILG

SEQ ID NO: 210792 - protein, 8 aa, Borrelia garinii
AGDTILGV

SEQ ID NO: 210793 - protein, 8 aa, Borrelia garinii
GDTILGVR

SEQ ID NO: 210794 - protein, 8 aa, Borrelia garinii
DTILGVRV

SEQ ID NO: 210795 - protein, 8 aa, Borrelia garinii
TILGVRVL

SEQ ID NO: 210796 - protein, 8 aa, Borrelia garinii
ILGVRVLF

SEQ ID NO: 210797 - protein, 8 aa, Borrelia garinii
LGVRVLFP

SEQ ID NO: 210798 - protein, 8 aa, Borrelia garinii
GVRVLFPS

SEQ ID NO: 210799 - protein, 8 aa, Borrelia garinii
VRVLFPSY

SEQ ID NO: 210800 - protein, 8 aa, Borrelia garinii
RVLFPSYS

SEQ ID NO: 210801 - protein, 8 aa, Borrelia garinii
VLFPSYSQ

SEQ ID NO: 210802 - protein, 8 aa, Borrelia garinii
LFPSYSQS

SEQ ID NO: 210803 - protein, 8 aa, Borrelia garinii
FPSYSQSS

SEQ ID NO: 210804 - protein, 8 aa, Borrelia garinii
PSYSQSSA

SEQ ID NO: 210805 - protein, 8 aa, Borrelia garinii
SYSQSSAM

SEQ ID NO: 210806 - protein, 8 aa, Borrelia garinii
YSQSSAMI

SEQ ID NO: 210807 - protein, 8 aa, Borrelia garinii
SQSSAMIM

SEQ ID NO: 210808 - protein, 8 aa, Borrelia garinii
QSSAMIMP

SEQ ID NO: 210809 - protein, 8 aa, Borrelia garinii
SSAMIMPP

SEQ ID NO: 210810 - protein, 8 aa, Borrelia garinii
SAMIMPPF

SEQ ID NO: 210811 - protein, 8 aa, Borrelia garinii
AMIMPPFK

SEQ ID NO: 210812 - protein, 8 aa, Borrelia garinii
MIMPPFKI

SEQ ID NO: 210813 - protein, 8 aa, Borrelia garinii
IMPPFKIP

SEQ ID NO: 210814 - protein, 8 aa, Borrelia garinii
MPPFKIPF

SEQ ID NO: 210815 - protein, 8 aa, Borrelia garinii
PPFKIPFY

SEQ ID NO: 210816 - protein, 8 aa, Borrelia garinii
PFKIPFYS

SEQ ID NO: 210817 - protein, 8 aa, Borrelia garinii
FKIPFYSG

SEQ ID NO: 210818 - protein, 8 aa, Borrelia garinii
KIPFYSGE

SEQ ID NO: 210819 - protein, 8 aa, Borrelia garinii
IPFYSGEN

SEQ ID NO: 210820 - protein, 8 aa, Borrelia garinii
PFYSGENG

SEQ ID NO: 210821 - protein, 8 aa, Borrelia garinii
FYSGENGN

SEQ ID NO: 210822 - protein, 8 aa, Borrelia garinii
YSGENGNQ

SEQ ID NO: 210823 - protein, 8 aa, Borrelia garinii
SGENGNQF

SEQ ID NO: 210824 - protein, 8 aa, Borrelia garinii
GENGNQFL

SEQ ID NO: 210825 - protein, 8 aa, Borrelia garinii
ENGNQFLG

SEQ ID NO: 210826 - protein, 8 aa, Borrelia garinii
NGNQFLGK

SEQ ID NO: 210827 - protein, 8 aa, Borrelia garinii
GNQFLGKG

SEQ ID NO: 210828 - protein, 8 aa, Borrelia garinii
NQFLGKGL

SEQ ID NO: 210829 - protein, 8 aa, Borrelia garinii
QFLGKGLI

SEQ ID NO: 210830 - protein, 8 aa, Borrelia garinii
FLGKGLIN

SEQ ID NO: 210831 - protein, 8 aa, Borrelia garinii
LGKGLINN

SEQ ID NO: 210832 - protein, 8 aa, Borrelia garinii
GKGLINNI

SEQ ID NO: 210833 - protein, 8 aa, Borrelia garinii
KGLINNIK

SEQ ID NO: 210834 - protein, 8 aa, Borrelia garinii
GLINNIKT

SEQ ID NO: 210835 - protein, 8 aa, Borrelia garinii
LINNIKTM

SEQ ID NO: 210836 - protein, 8 aa, Borrelia garinii
INNIKTMK

SEQ ID NO: 210837 - protein, 8 aa, Borrelia garinii
NNIKTMKE

SEQ ID NO: 210838 - protein, 8 aa, Borrelia garinii
NIKTMKEI

SEQ ID NO: 210839 - protein, 8 aa, Borrelia garinii
IKTMKEIK

SEQ ID NO: 210840 - protein, 8 aa, Borrelia garinii
KTMKEIKV

SEQ ID NO: 210841 - protein, 8 aa, Borrelia garinii
TMKEIKVS

SEQ ID NO: 210842 - protein, 8 aa, Borrelia garinii
MKEIKVSV

SEQ ID NO: 210843 - protein, 8 aa, Borrelia garinii
KEIKVSVY

SEQ ID NO: 210844 - protein, 8 aa, Borrelia garinii
EIKVSVYS

SEQ ID NO: 210845 - protein, 8 aa, Borrelia garinii
IKVSVYSL

SEQ ID NO: 210846 - protein, 8 aa, Borrelia garinii
KVSVYSLG

SEQ ID NO: 210847 - protein, 8 aa, Borrelia garinii
VSVYSLGY

SEQ ID NO: 210848 - protein, 8 aa, Borrelia garinii
SVYSLGYE

SEQ ID NO: 210849 - protein, 8 aa, Borrelia garinii
VYSLGYEI

SEQ ID NO: 210850 - protein, 8 aa, Borrelia garinii
YSLGYEID

SEQ ID NO: 210851 - protein, 8 aa, Borrelia garinii
SLGYEIDL

SEQ ID NO: 210852 - protein, 8 aa, Borrelia garinii
LGYEIDLE

SEQ ID NO: 210853 - protein, 8 aa, Borrelia garinii
GYEIDLEV

SEQ ID NO: 210854 - protein, 8 aa, Borrelia garinii
YEIDLEVL

SEQ ID NO: 210855 - protein, 8 aa, Borrelia garinii
EIDLEVLF

SEQ ID NO: 210856 - protein, 8 aa, Borrelia garinii
IDLEVLFE

SEQ ID NO: 210857 - protein, 8 aa, Borrelia garinii
DLEVLFED

SEQ ID NO: 210858 - protein, 8 aa, Borrelia garinii
LEVLFEDM

SEQ ID NO: 210859 - protein, 8 aa, Borrelia garinii
EVLFEDMN

SEQ ID NO: 210860 - protein, 8 aa, Borrelia garinii
VLFEDMNG

SEQ ID NO: 210861 - protein, 8 aa, Borrelia garinii
LFEDMNGM

SEQ ID NO: 210862 - protein, 8 aa, Borrelia garinii
FEDMNGME

SEQ ID NO: 210863 - protein, 8 aa, Borrelia garinii
EDMNGMEY

SEQ ID NO: 210864 - protein, 8 aa, Borrelia garinii
DMNGMEYA

SEQ ID NO: 210865 - protein, 8 aa, Borrelia garinii
MNGMEYAY

SEQ ID NO: 210866 - protein, 8 aa, Borrelia garinii
NGMEYAYS

SEQ ID NO: 210867 - protein, 8 aa, Borrelia garinii
GMEYAYSL

SEQ ID NO: 210868 - protein, 8 aa, Borrelia garinii
MEYAYSLG

SEQ ID NO: 210869 - protein, 8 aa, Borrelia garinii
EYAYSLGT

SEQ ID NO: 210870 - protein, 8 aa, Borrelia garinii
YAYSLGTL

SEQ ID NO: 210871 - protein, 8 aa, Borrelia garinii
AYSLGTLK

SEQ ID NO: 210872 - protein, 8 aa, Borrelia garinii
YSLGTLKF

SEQ ID NO: 210873 - protein, 8 aa, Borrelia garinii
SLGTLKFK

SEQ ID NO: 210874 - protein, 8 aa, Borrelia garinii
LGTLKFKG

SEQ ID NO: 210875 - protein, 8 aa, Borrelia garinii
GTLKFKGW

SEQ ID NO: 210876 - protein, 8 aa, Borrelia garinii
TLKFKGWA

SEQ ID NO: 210877 - protein, 8 aa, Borrelia garinii
LKFKGWAD

SEQ ID NO: 210878 - protein, 8 aa, Borrelia garinii
KFKGWADL

SEQ ID NO: 210879 - protein, 8 aa, Borrelia garinii
FKGWADLI

SEQ ID NO: 210880 - protein, 8 aa, Borrelia garinii
KGWADLIW

SEQ ID NO: 210881 - protein, 8 aa, Borrelia garinii
GWADLIWS

SEQ ID NO: 210882 - protein, 8 aa, Borrelia garinii
WADLIWSN

SEQ ID NO: 210883 - protein, 8 aa, Borrelia garinii
ADLIWSNP

SEQ ID NO: 210884 - protein, 8 aa, Borrelia garinii
DLIWSNPN

SEQ ID NO: 210885 - protein, 8 aa, Borrelia garinii
LIWSNPNY

SEQ ID NO: 210886 - protein, 8 aa, Borrelia garinii
IWSNPNYI

SEQ ID NO: 210887 - protein, 8 aa, Borrelia garinii
WSNPNYIP

SEQ ID NO: 210888 - protein, 8 aa, Borrelia garinii
SNPNYIPN

SEQ ID NO: 210889 - protein, 8 aa, Borrelia garinii
NPNYIPNI

SEQ ID NO: 210890 - protein, 8 aa, Borrelia garinii
PNYIPNIS

SEQ ID NO: 210891 - protein, 8 aa, Borrelia garinii
NYIPNISS

SEQ ID NO: 210892 - protein, 8 aa, Borrelia garinii
YIPNISSR

SEQ ID NO: 210893 - protein, 8 aa, Borrelia garinii
IPNISSRI

SEQ ID NO: 210894 - protein, 8 aa, Borrelia garinii
PNISSRII

SEQ ID NO: 210895 - protein, 8 aa, Borrelia garinii
NISSRIIK

SEQ ID NO: 210896 - protein, 8 aa, Borrelia garinii
ISSRIIKD

SEQ ID NO: 210897 - protein, 8 aa, Borrelia garinii
SSRIIKDD

SEQ ID NO: 210898 - protein, 8 aa, Borrelia garinii
SRIIKDDV

SEQ ID NO: 210899 - protein, 8 aa, Borrelia garinii
RIIKDDVP

SEQ ID NO: 210900 - protein, 8 aa, Borrelia garinii
IIKDDVPN

SEQ ID NO: 210901 - protein, 8 aa, Borrelia garinii
IKDDVPNY

SEQ ID NO: 210902 - protein, 8 aa, Borrelia garinii
KDDVPNYP

SEQ ID NO: 210903 - protein, 8 aa, Borrelia garinii
DDVPNYPL

SEQ ID NO: 210904 - protein, 8 aa, Borrelia garinii
DVPNYPLA

SEQ ID NO: 210905 - protein, 8 aa, Borrelia garinii
VPNYPLAS

SEQ ID NO: 210906 - protein, 8 aa, Borrelia garinii
PNYPLASS

SEQ ID NO: 210907 - protein, 8 aa, Borrelia garinii
NYPLASSK

SEQ ID NO: 210908 - protein, 8 aa, Borrelia garinii
YPLASSKM

SEQ ID NO: 210909 - protein, 8 aa, Borrelia garinii
PLASSKMR

SEQ ID NO: 210910 - protein, 8 aa, Borrelia garinii
LASSKMRF

SEQ ID NO: 210911 - protein, 8 aa, Borrelia garinii
ASSKMRFK

SEQ ID NO: 210912 - protein, 8 aa, Borrelia garinii
SSKMRFKA

SEQ ID NO: 210913 - protein, 8 aa, Borrelia garinii
SKMRFKAF

SEQ ID NO: 210914 - protein, 8 aa, Borrelia garinii
KMRFKAFR

SEQ ID NO: 210915 - protein, 8 aa, Borrelia garinii
MRFKAFRV

SEQ ID NO: 210916 - protein, 8 aa, Borrelia garinii
RFKAFRVS

SEQ ID NO: 210917 - protein, 8 aa, Borrelia garinii
FKAFRVSK

SEQ ID NO: 210918 - protein, 8 aa, Borrelia garinii
KAFRVSKS

SEQ ID NO: 210919 - protein, 8 aa, Borrelia garinii
AFRVSKSH

SEQ ID NO: 210920 - protein, 8 aa, Borrelia garinii
FRVSKSHS

SEQ ID NO: 210921 - protein, 8 aa, Borrelia garinii
RVSKSHSS

SEQ ID NO: 210922 - protein, 8 aa, Borrelia garinii
VSKSHSSK

SEQ ID NO: 210923 - protein, 8 aa, Borrelia garinii
SKSHSSKE

SEQ ID NO: 210924 - protein, 8 aa, Borrelia garinii
KSHSSKEQ

SEQ ID NO: 210925 - protein, 8 aa, Borrelia garinii
SHSSKEQN

SEQ ID NO: 210926 - protein, 8 aa, Borrelia garinii
HSSKEQNF

SEQ ID NO: 210927 - protein, 8 aa, Borrelia garinii
SSKEQNFI

SEQ ID NO: 210928 - protein, 8 aa, Borrelia garinii
SKEQNFIF

SEQ ID NO: 210929 - protein, 8 aa, Borrelia garinii
KEQNFIFY

SEQ ID NO: 210930 - protein, 8 aa, Borrelia garinii
EQNFIFYV

SEQ ID NO: 210931 - protein, 8 aa, Borrelia garinii
QNFIFYVK

SEQ ID NO: 210932 - protein, 8 aa, Borrelia garinii
NFIFYVKD

SEQ ID NO: 210933 - protein, 8 aa, Borrelia garinii
FIFYVKDL

SEQ ID NO: 210934 - protein, 8 aa, Borrelia garinii
IFYVKDLR

SEQ ID NO: 210935 - protein, 8 aa, Borrelia garinii
FYVKDLRV

SEQ ID NO: 210936 - protein, 8 aa, Borrelia garinii
YVKDLRVL

SEQ ID NO: 210937 - protein, 8 aa, Borrelia garinii
VKDLRVLY

SEQ ID NO: 210938 - protein, 8 aa, Borrelia garinii
KDLRVLYD

SEQ ID NO: 210939 - protein, 8 aa, Borrelia garinii
DLRVLYDK

SEQ ID NO: 210940 - protein, 8 aa, Borrelia garinii
LRVLYDKL

SEQ ID NO: 210941 - protein, 8 aa, Borrelia garinii
RVLYDKLS

SEQ ID NO: 210942 - protein, 8 aa, Borrelia garinii
VLYDKLSV

SEQ ID NO: 210943 - protein, 8 aa, Borrelia garinii
LYDKLSVS

SEQ ID NO: 210944 - protein, 8 aa, Borrelia garinii
YDKLSVSI

SEQ ID NO: 210945 - protein, 8 aa, Borrelia garinii
DKLSVSID

SEQ ID NO: 210946 - protein, 8 aa, Borrelia garinii
KLSVSIDS

SEQ ID NO: 210947 - protein, 8 aa, Borrelia garinii
LSVSIDSD

SEQ ID NO: 210948 - protein, 8 aa, Borrelia garinii
SVSIDSDI

SEQ ID NO: 210949 - protein, 8 aa, Borrelia garinii
VSIDSDID

SEQ ID NO: 210950 - protein, 8 aa, Borrelia garinii
SIDSDIDS

SEQ ID NO: 210951 - protein, 8 aa, Borrelia garinii
IDSDIDSE

SEQ ID NO: 210952 - protein, 8 aa, Borrelia garinii
DSDIDSES

SEQ ID NO: 210953 - protein, 8 aa, Borrelia garinii
SDIDSESV

SEQ ID NO: 210954 - protein, 8 aa, Borrelia garinii
DIDSESVF

SEQ ID NO: 210955 - protein, 8 aa, Borrelia garinii
IDSESVFK

SEQ ID NO: 210956 - protein, 8 aa, Borrelia garinii
DSESVFKV

SEQ ID NO: 210957 - protein, 8 aa, Borrelia garinii
SESVFKVY

SEQ ID NO: 210958 - protein, 8 aa, Borrelia garinii
ESVFKVYE

SEQ ID NO: 210959 - protein, 8 aa, Borrelia garinii
SVFKVYET

SEQ ID NO: 210960 - protein, 8 aa, Borrelia garinii
VFKVYETS

SEQ ID NO: 210961 - protein, 8 aa, Borrelia garinii
FKVYETSG

SEQ ID NO: 210962 - protein, 8 aa, Borrelia garinii
KVYETSGT

SEQ ID NO: 210963 - protein, 8 aa, Borrelia garinii
VYETSGTE

SEQ ID NO: 210964 - protein, 8 aa, Borrelia garinii
YETSGTES

SEQ ID NO: 210965 - protein, 8 aa, Borrelia garinii
ETSGTESL

SEQ ID NO: 210966 - protein, 8 aa, Borrelia garinii
TSGTESLR

SEQ ID NO: 210967 - protein, 8 aa, Borrelia garinii
SGTESLRK

SEQ ID NO: 210968 - protein, 8 aa, Borrelia garinii
GTESLRKL

SEQ ID NO: 210969 - protein, 8 aa, Borrelia garinii
TESLRKLK

SEQ ID NO: 210970 - protein, 8 aa, Borrelia garinii
ESLRKLKA

SEQ ID NO: 210971 - protein, 8 aa, Borrelia garinii
SLRKLKAH

SEQ ID NO: 210972 - protein, 8 aa, Borrelia garinii
LRKLKAHE

SEQ ID NO: 210973 - protein, 8 aa, Borrelia garinii
RKLKAHET

SEQ ID NO: 210974 - protein, 8 aa, Borrelia garinii
KLKAHETF

SEQ ID NO: 210975 - protein, 8 aa, Borrelia garinii
LKAHETFK

SEQ ID NO: 210976 - protein, 8 aa, Borrelia garinii
KAHETFKR

SEQ ID NO: 210977 - protein, 8 aa, Borrelia garinii
AHETFKRV

SEQ ID NO: 210978 - protein, 8 aa, Borrelia garinii
HETFKRVL

SEQ ID NO: 210979 - protein, 8 aa, Borrelia garinii
ETFKRVLK

SEQ ID NO: 210980 - protein, 8 aa, Borrelia garinii
TFKRVLKL

SEQ ID NO: 210981 - protein, 8 aa, Borrelia garinii
FKRVLKLR

SEQ ID NO: 210982 - protein, 8 aa, Borrelia garinii
KRVLKLRE

SEQ ID NO: 210983 - protein, 8 aa, Borrelia garinii
RVLKLREK

SEQ ID NO: 210984 - protein, 8 aa, Borrelia garinii
VLKLREKI

SEQ ID NO: 210985 - protein, 8 aa, Borrelia garinii
LKLREKIS

SEQ ID NO: 210986 - protein, 8 aa, Borrelia garinii
KLREKISM

SEQ ID NO: 210987 - protein, 8 aa, Borrelia garinii
LREKISMP

SEQ ID NO: 210988 - protein, 8 aa, Borrelia garinii
REKISMPE

SEQ ID NO: 210989 - protein, 8 aa, Borrelia garinii
EKISMPEG

SEQ ID NO: 210990 - protein, 8 aa, Borrelia garinii
KISMPEGS

SEQ ID NO: 210991 - protein, 8 aa, Borrelia garinii
ISMPEGSF

SEQ ID NO: 210992 - protein, 8 aa, Borrelia garinii
SMPEGSFQ

SEQ ID NO: 210993 - protein, 8 aa, Borrelia garinii
MPEGSFQN

SEQ ID NO: 210994 - protein, 8 aa, Borrelia garinii
PEGSFQNF

SEQ ID NO: 210995 - protein, 8 aa, Borrelia garinii
EGSFQNFI

SEQ ID NO: 210996 - protein, 8 aa, Borrelia garinii
GSFQNFIE

SEQ ID NO: 210997 - protein, 8 aa, Borrelia garinii
SFQNFIEK

SEQ ID NO: 210998 - protein, 8 aa, Borrelia garinii
FQNFIEKV

SEQ ID NO: 210999 - protein, 8 aa, Borrelia garinii
QNFIEKVE

SEQ ID NO: 211000 - protein, 8 aa, Borrelia garinii
NFIEKVES

SEQ ID NO: 211001 - protein, 8 aa, Borrelia garinii
FIEKVESE

SEQ ID NO: 211002 - protein, 8 aa, Borrelia garinii
IEKVESEK

SEQ ID NO: 211003 - protein, 8 aa, Borrelia garinii
EKVESEKK

SEQ ID NO: 211004 - protein, 8 aa, Borrelia garinii
KVESEKKP

SEQ ID NO: 211005 - protein, 8 aa, Borrelia garinii
VESEKKPE

SEQ ID NO: 211006 - protein, 8 aa, Borrelia garinii
ESEKKPEE

SEQ ID NO: 211007 - protein, 8 aa, Borrelia garinii
SEKKPEES

SEQ ID NO: 211008 - protein, 8 aa, Borrelia garinii
EKKPEESS

SEQ ID NO: 211009 - protein, 8 aa, Borrelia garinii
KKPEESSL

SEQ ID NO: 211010 - protein, 8 aa, Borrelia garinii
KPEESSLK

SEQ ID NO: 211011 - protein, 8 aa, Borrelia garinii
PEESSLKK

SEQ ID NO: 211012 - protein, 9 aa, Borrelia garinii
MKRKAKSIL

SEQ ID NO: 211013 - protein, 9 aa, Borrelia garinii
KRKAKSILL

SEQ ID NO: 211014 - protein, 9 aa, Borrelia garinii
RKAKSILLF

SEQ ID NO: 211015 - protein, 9 aa, Borrelia garinii
KAKSILLFL

SEQ ID NO: 211016 - protein, 9 aa, Borrelia garinii
AKSILLFLL

SEQ ID NO: 211017 - protein, 9 aa, Borrelia garinii
KSILLFLLS

SEQ ID NO: 211018 - protein, 9 aa, Borrelia garinii
SILLFLLST

SEQ ID NO: 211019 - protein, 9 aa, Borrelia garinii
ILLFLLSTA

SEQ ID NO: 211020 - protein, 9 aa, Borrelia garinii
LLFLLSTAL

SEQ ID NO: 211021 - protein, 9 aa, Borrelia garinii
LFLLSTALF

SEQ ID NO: 211022 - protein, 9 aa, Borrelia garinii
FLLSTALFA

SEQ ID NO: 211023 - protein, 9 aa, Borrelia garinii
LLSTALFAQ

SEQ ID NO: 211024 - protein, 9 aa, Borrelia garinii
LSTALFAQE

SEQ ID NO: 211025 - protein, 9 aa, Borrelia garinii
STALFAQET

SEQ ID NO: 211026 - protein, 9 aa, Borrelia garinii
TALFAQETD

SEQ ID NO: 211027 - protein, 9 aa, Borrelia garinii
ALFAQETDG

SEQ ID NO: 211028 - protein, 9 aa, Borrelia garinii
LFAQETDGL

SEQ ID NO: 211029 - protein, 9 aa, Borrelia garinii
FAQETDGLP

SEQ ID NO: 211030 - protein, 9 aa, Borrelia garinii
AQETDGLPE

SEQ ID NO: 211031 - protein, 9 aa, Borrelia garinii
QETDGLPEG

SEQ ID NO: 211032 - protein, 9 aa, Borrelia garinii
ETDGLPEGS

SEQ ID NO: 211033 - protein, 9 aa, Borrelia garinii
TDGLPEGSK

SEQ ID NO: 211034 - protein, 9 aa, Borrelia garinii
DGLPEGSKR

SEQ ID NO: 211035 - protein, 9 aa, Borrelia garinii
GLPEGSKRS

SEQ ID NO: 211036 - protein, 9 aa, Borrelia garinii
LPEGSKRSE

SEQ ID NO: 211037 - protein, 9 aa, Borrelia garinii
PEGSKRSEP

SEQ ID NO: 211038 - protein, 9 aa, Borrelia garinii
EGSKRSEPG

SEQ ID NO: 211039 - protein, 9 aa, Borrelia garinii
GSKRSEPGE

SEQ ID NO: 211040 - protein, 9 aa, Borrelia garinii
SKRSEPGEL

SEQ ID NO: 211041 - protein, 9 aa, Borrelia garinii
KRSEPGELV

SEQ ID NO: 211042 - protein, 9 aa, Borrelia garinii
RSEPGELVL

SEQ ID NO: 211043 - protein, 9 aa, Borrelia garinii
SEPGELVLD

SEQ ID NO: 211044 - protein, 9 aa, Borrelia garinii
EPGELVLDF

SEQ ID NO: 211045 - protein, 9 aa, Borrelia garinii
PGELVLDFA

SEQ ID NO: 211046 - protein, 9 aa, Borrelia garinii
GELVLDFAE

SEQ ID NO: 211047 - protein, 9 aa, Borrelia garinii
ELVLDFAEL

SEQ ID NO: 211048 - protein, 9 aa, Borrelia garinii
LVLDFAELA

SEQ ID NO: 211049 - protein, 9 aa, Borrelia garinii
VLDFAELAR

SEQ ID NO: 211050 - protein, 9 aa, Borrelia garinii
LDFAELARD

SEQ ID NO: 211051 - protein, 9 aa, Borrelia garinii
DFAELARDP

SEQ ID NO: 211052 - protein, 9 aa, Borrelia garinii
FAELARDPS

SEQ ID NO: 211053 - protein, 9 aa, Borrelia garinii
AELARDPSS

SEQ ID NO: 211054 - protein, 9 aa, Borrelia garinii
ELARDPSST

SEQ ID NO: 211055 - protein, 9 aa, Borrelia garinii
LARDPSSTK

SEQ ID NO: 211056 - protein, 9 aa, Borrelia garinii
ARDPSSTKL

SEQ ID NO: 211057 - protein, 9 aa, Borrelia garinii
RDPSSTKLD

SEQ ID NO: 211058 - protein, 9 aa, Borrelia garinii
DPSSTKLDL

SEQ ID NO: 211059 - protein, 9 aa, Borrelia garinii
PSSTKLDLT

SEQ ID NO: 211060 - protein, 9 aa, Borrelia garinii
SSTKLDLTN

SEQ ID NO: 211061 - protein, 9 aa, Borrelia garinii
STKLDLTNY

SEQ ID NO: 211062 - protein, 9 aa, Borrelia garinii
TKLDLTNYV

SEQ ID NO: 211063 - protein, 9 aa, Borrelia garinii
KLDLTNYVD

SEQ ID NO: 211064 - protein, 9 aa, Borrelia garinii
LDLTNYVDY

SEQ ID NO: 211065 - protein, 9 aa, Borrelia garinii
DLTNYVDYV

SEQ ID NO: 211066 - protein, 9 aa, Borrelia garinii
LTNYVDYVY

SEQ ID NO: 211067 - protein, 9 aa, Borrelia garinii
TNYVDYVYS

SEQ ID NO: 211068 - protein, 9 aa, Borrelia garinii
NYVDYVYSG

SEQ ID NO: 211069 - protein, 9 aa, Borrelia garinii
YVDYVYSGA

SEQ ID NO: 211070 - protein, 9 aa, Borrelia garinii
VDYVYSGAS

SEQ ID NO: 211071 - protein, 9 aa, Borrelia garinii
DYVYSGASG

SEQ ID NO: 211072 - protein, 9 aa, Borrelia garinii
YVYSGASGI

SEQ ID NO: 211073 - protein, 9 aa, Borrelia garinii
VYSGASGIV

SEQ ID NO: 211074 - protein, 9 aa, Borrelia garinii
YSGASGIVK

SEQ ID NO: 211075 - protein, 9 aa, Borrelia garinii
SGASGIVKP

SEQ ID NO: 211076 - protein, 9 aa, Borrelia garinii
GASGIVKPE

SEQ ID NO: 211077 - protein, 9 aa, Borrelia garinii
ASGIVKPED

SEQ ID NO: 211078 - protein, 9 aa, Borrelia garinii
SGIVKPEDM

SEQ ID NO: 211079 - protein, 9 aa, Borrelia garinii
GIVKPEDMV

SEQ ID NO: 211080 - protein, 9 aa, Borrelia garinii
IVKPEDMVV

SEQ ID NO: 211081 - protein, 9 aa, Borrelia garinii
VKPEDMVVD

SEQ ID NO: 211082 - protein, 9 aa, Borrelia garinii
KPEDMVVDL

SEQ ID NO: 211083 - protein, 9 aa, Borrelia garinii
PEDMVVDLG

SEQ ID NO: 211084 - protein, 9 aa, Borrelia garinii
EDMVVDLGI

SEQ ID NO: 211085 - protein, 9 aa, Borrelia garinii
DMVVDLGIN

SEQ ID NO: 211086 - protein, 9 aa, Borrelia garinii
MVVDLGINN

SEQ ID NO: 211087 - protein, 9 aa, Borrelia garinii
VVDLGINNW

SEQ ID NO: 211088 - protein, 9 aa, Borrelia garinii
VDLGINNWS

SEQ ID NO: 211089 - protein, 9 aa, Borrelia garinii
DLGINNWSV

SEQ ID NO: 211090 - protein, 9 aa, Borrelia garinii
LGINNWSVL

SEQ ID NO: 211091 - protein, 9 aa, Borrelia garinii
GINNWSVLL

SEQ ID NO: 211092 - protein, 9 aa, Borrelia garinii
INNWSVLLT

SEQ ID NO: 211093 - protein, 9 aa, Borrelia garinii
NNWSVLLTP

SEQ ID NO: 211094 - protein, 9 aa, Borrelia garinii
NWSVLLTPS

SEQ ID NO: 211095 - protein, 9 aa, Borrelia garinii
WSVLLTPSA

SEQ ID NO: 211096 - protein, 9 aa, Borrelia garinii
SVLLTPSAR

SEQ ID NO: 211097 - protein, 9 aa, Borrelia garinii
VLLTPSARL

SEQ ID NO: 211098 - protein, 9 aa, Borrelia garinii
LLTPSARLQ

SEQ ID NO: 211099 - protein, 9 aa, Borrelia garinii
LTPSARLQA

SEQ ID NO: 211100 - protein, 9 aa, Borrelia garinii
TPSARLQAY

SEQ ID NO: 211101 - protein, 9 aa, Borrelia garinii
PSARLQAYV

SEQ ID NO: 211102 - protein, 9 aa, Borrelia garinii
SARLQAYVK

SEQ ID NO: 211103 - protein, 9 aa, Borrelia garinii
ARLQAYVKN

SEQ ID NO: 211104 - protein, 9 aa, Borrelia garinii
RLQAYVKNS

SEQ ID NO: 211105 - protein, 9 aa, Borrelia garinii
LQAYVKNSV

SEQ ID NO: 211106 - protein, 9 aa, Borrelia garinii
QAYVKNSVV

SEQ ID NO: 211107 - protein, 9 aa, Borrelia garinii
AYVKNSVVA

SEQ ID NO: 211108 - protein, 9 aa, Borrelia garinii
YVKNSVVAP

SEQ ID NO: 211109 - protein, 9 aa, Borrelia garinii
VKNSVVAPA

SEQ ID NO: 211110 - protein, 9 aa, Borrelia garinii
KNSVVAPAV

SEQ ID NO: 211111 - protein, 9 aa, Borrelia garinii
NSVVAPAVV

SEQ ID NO: 211112 - protein, 9 aa, Borrelia garinii
SVVAPAVVK

SEQ ID NO: 211113 - protein, 9 aa, Borrelia garinii
VVAPAVVKS

SEQ ID NO: 211114 - protein, 9 aa, Borrelia garinii
VAPAVVKSE

SEQ ID NO: 211115 - protein, 9 aa, Borrelia garinii
APAVVKSES

SEQ ID NO: 211116 - protein, 9 aa, Borrelia garinii
PAVVKSESK

SEQ ID NO: 211117 - protein, 9 aa, Borrelia garinii
AVVKSESKR

SEQ ID NO: 211118 - protein, 9 aa, Borrelia garinii
VVKSESKRY

SEQ ID NO: 211119 - protein, 9 aa, Borrelia garinii
VKSESKRYA

SEQ ID NO: 211120 - protein, 9 aa, Borrelia garinii
KSESKRYAG

SEQ ID NO: 211121 - protein, 9 aa, Borrelia garinii
SESKRYAGD

SEQ ID NO: 211122 - protein, 9 aa, Borrelia garinii
ESKRYAGDT

SEQ ID NO: 211123 - protein, 9 aa, Borrelia garinii
SKRYAGDTI

SEQ ID NO: 211124 - protein, 9 aa, Borrelia garinii
KRYAGDTIL

SEQ ID NO: 211125 - protein, 9 aa, Borrelia garinii
RYAGDTILG

SEQ ID NO: 211126 - protein, 9 aa, Borrelia garinii
YAGDTILGV

SEQ ID NO: 211127 - protein, 9 aa, Borrelia garinii
AGDTILGVR

SEQ ID NO: 211128 - protein, 9 aa, Borrelia garinii
GDTILGVRV

SEQ ID NO: 211129 - protein, 9 aa, Borrelia garinii
DTILGVRVL

SEQ ID NO: 211130 - protein, 9 aa, Borrelia garinii
TILGVRVLF

SEQ ID NO: 211131 - protein, 9 aa, Borrelia garinii
ILGVRVLFP

SEQ ID NO: 211132 - protein, 9 aa, Borrelia garinii
LGVRVLFPS

SEQ ID NO: 211133 - protein, 9 aa, Borrelia garinii
GVRVLFPSY

SEQ ID NO: 211134 - protein, 9 aa, Borrelia garinii
VRVLFPSYS

SEQ ID NO: 211135 - protein, 9 aa, Borrelia garinii
RVLFPSYSQ

SEQ ID NO: 211136 - protein, 9 aa, Borrelia garinii
VLFPSYSQS

SEQ ID NO: 211137 - protein, 9 aa, Borrelia garinii
LFPSYSQSS

SEQ ID NO: 211138 - protein, 9 aa, Borrelia garinii
FPSYSQSSA

SEQ ID NO: 211139 - protein, 9 aa, Borrelia garinii
PSYSQSSAM

SEQ ID NO: 211140 - protein, 9 aa, Borrelia garinii
SYSQSSAMI

SEQ ID NO: 211141 - protein, 9 aa, Borrelia garinii
YSQSSAMIM

SEQ ID NO: 211142 - protein, 9 aa, Borrelia garinii
SQSSAMIMP

SEQ ID NO: 211143 - protein, 9 aa, Borrelia garinii
QSSAMIMPP

SEQ ID NO: 211144 - protein, 9 aa, Borrelia garinii
SSAMIMPPF

SEQ ID NO: 211145 - protein, 9 aa, Borrelia garinii
SAMIMPPFK

SEQ ID NO: 211146 - protein, 9 aa, Borrelia garinii
AMIMPPFKI

SEQ ID NO: 211147 - protein, 9 aa, Borrelia garinii
MIMPPFKIP

SEQ ID NO: 211148 - protein, 9 aa, Borrelia garinii
IMPPFKIPF

SEQ ID NO: 211149 - protein, 9 aa, Borrelia garinii
MPPFKIPFY

SEQ ID NO: 211150 - protein, 9 aa, Borrelia garinii
PPFKIPFYS

SEQ ID NO: 211151 - protein, 9 aa, Borrelia garinii
PFKIPFYSG

SEQ ID NO: 211152 - protein, 9 aa, Borrelia garinii
FKIPFYSGE

SEQ ID NO: 211153 - protein, 9 aa, Borrelia garinii
KIPFYSGEN

SEQ ID NO: 211154 - protein, 9 aa, Borrelia garinii
IPFYSGENG

SEQ ID NO: 211155 - protein, 9 aa, Borrelia garinii
PFYSGENGN

SEQ ID NO: 211156 - protein, 9 aa, Borrelia garinii
FYSGENGNQ

SEQ ID NO: 211157 - protein, 9 aa, Borrelia garinii
YSGENGNQF

SEQ ID NO: 211158 - protein, 9 aa, Borrelia garinii
SGENGNQFL

SEQ ID NO: 211159 - protein, 9 aa, Borrelia garinii
GENGNQFLG

SEQ ID NO: 211160 - protein, 9 aa, Borrelia garinii
ENGNQFLGK

SEQ ID NO: 211161 - protein, 9 aa, Borrelia garinii
NGNQFLGKG

SEQ ID NO: 211162 - protein, 9 aa, Borrelia garinii
GNQFLGKGL

SEQ ID NO: 211163 - protein, 9 aa, Borrelia garinii
NQFLGKGLI

SEQ ID NO: 211164 - protein, 9 aa, Borrelia garinii
QFLGKGLIN

SEQ ID NO: 211165 - protein, 9 aa, Borrelia garinii
FLGKGLINN

SEQ ID NO: 211166 - protein, 9 aa, Borrelia garinii
LGKGLINNI

SEQ ID NO: 211167 - protein, 9 aa, Borrelia garinii
GKGLINNIK

SEQ ID NO: 211168 - protein, 9 aa, Borrelia garinii
KGLINNIKT

SEQ ID NO: 211169 - protein, 9 aa, Borrelia garinii
GLINNIKTM

SEQ ID NO: 211170 - protein, 9 aa, Borrelia garinii
LINNIKTMK

SEQ ID NO: 211171 - protein, 9 aa, Borrelia garinii
INNIKTMKE

SEQ ID NO: 211172 - protein, 9 aa, Borrelia garinii
NNIKTMKEI

SEQ ID NO: 211173 - protein, 9 aa, Borrelia garinii
NIKTMKEIK

SEQ ID NO: 211174 - protein, 9 aa, Borrelia garinii
IKTMKEIKV

SEQ ID NO: 211175 - protein, 9 aa, Borrelia garinii
KTMKEIKVS

SEQ ID NO: 211176 - protein, 9 aa, Borrelia garinii
TMKEIKVSV

SEQ ID NO: 211177 - protein, 9 aa, Borrelia garinii
MKEIKVSVY

SEQ ID NO: 211178 - protein, 9 aa, Borrelia garinii
KEIKVSVYS

SEQ ID NO: 211179 - protein, 9 aa, Borrelia garinii
EIKVSVYSL

SEQ ID NO: 211180 - protein, 9 aa, Borrelia garinii
IKVSVYSLG

SEQ ID NO: 211181 - protein, 9 aa, Borrelia garinii
KVSVYSLGY

SEQ ID NO: 211182 - protein, 9 aa, Borrelia garinii
VSVYSLGYE

SEQ ID NO: 211183 - protein, 9 aa, Borrelia garinii
SVYSLGYEI

SEQ ID NO: 211184 - protein, 9 aa, Borrelia garinii
VYSLGYEID

SEQ ID NO: 211185 - protein, 9 aa, Borrelia garinii
YSLGYEIDL

SEQ ID NO: 211186 - protein, 9 aa, Borrelia garinii
SLGYEIDLE

SEQ ID NO: 211187 - protein, 9 aa, Borrelia garinii
LGYEIDLEV

SEQ ID NO: 211188 - protein, 9 aa, Borrelia garinii
GYEIDLEVL

SEQ ID NO: 211189 - protein, 9 aa, Borrelia garinii
YEIDLEVLF

SEQ ID NO: 211190 - protein, 9 aa, Borrelia garinii
EIDLEVLFE

SEQ ID NO: 211191 - protein, 9 aa, Borrelia garinii
IDLEVLFED

SEQ ID NO: 211192 - protein, 9 aa, Borrelia garinii
DLEVLFEDM

SEQ ID NO: 211193 - protein, 9 aa, Borrelia garinii
LEVLFEDMN

SEQ ID NO: 211194 - protein, 9 aa, Borrelia garinii
EVLFEDMNG

SEQ ID NO: 211195 - protein, 9 aa, Borrelia garinii
VLFEDMNGM

SEQ ID NO: 211196 - protein, 9 aa, Borrelia garinii
LFEDMNGME

SEQ ID NO: 211197 - protein, 9 aa, Borrelia garinii
FEDMNGMEY

SEQ ID NO: 211198 - protein, 9 aa, Borrelia garinii
EDMNGMEYA

SEQ ID NO: 211199 - protein, 9 aa, Borrelia garinii
DMNGMEYAY

SEQ ID NO: 211200 - protein, 9 aa, Borrelia garinii
MNGMEYAYS

SEQ ID NO: 211201 - protein, 9 aa, Borrelia garinii
NGMEYAYSL

SEQ ID NO: 211202 - protein, 9 aa, Borrelia garinii
GMEYAYSLG

SEQ ID NO: 211203 - protein, 9 aa, Borrelia garinii
MEYAYSLGT

SEQ ID NO: 211204 - protein, 9 aa, Borrelia garinii
EYAYSLGTL

SEQ ID NO: 211205 - protein, 9 aa, Borrelia garinii
YAYSLGTLK

SEQ ID NO: 211206 - protein, 9 aa, Borrelia garinii
AYSLGTLKF

SEQ ID NO: 211207 - protein, 9 aa, Borrelia garinii
YSLGTLKFK

SEQ ID NO: 211208 - protein, 9 aa, Borrelia garinii
SLGTLKFKG

SEQ ID NO: 211209 - protein, 9 aa, Borrelia garinii
LGTLKFKGW

SEQ ID NO: 211210 - protein, 9 aa, Borrelia garinii
GTLKFKGWA

SEQ ID NO: 211211 - protein, 9 aa, Borrelia garinii
TLKFKGWAD

SEQ ID NO: 211212 - protein, 9 aa, Borrelia garinii
LKFKGWADL

SEQ ID NO: 211213 - protein, 9 aa, Borrelia garinii
KFKGWADLI

SEQ ID NO: 211214 - protein, 9 aa, Borrelia garinii
FKGWADLIW

SEQ ID NO: 211215 - protein, 9 aa, Borrelia garinii
KGWADLIWS

SEQ ID NO: 211216 - protein, 9 aa, Borrelia garinii
GWADLIWSN

SEQ ID NO: 211217 - protein, 9 aa, Borrelia garinii
WADLIWSNP

SEQ ID NO: 211218 - protein, 9 aa, Borrelia garinii
ADLIWSNPN

SEQ ID NO: 211219 - protein, 9 aa, Borrelia garinii
DLIWSNPNY

SEQ ID NO: 211220 - protein, 9 aa, Borrelia garinii
LIWSNPNYI

SEQ ID NO: 211221 - protein, 9 aa, Borrelia garinii
IWSNPNYIP

SEQ ID NO: 211222 - protein, 9 aa, Borrelia garinii
WSNPNYIPN

SEQ ID NO: 211223 - protein, 9 aa, Borrelia garinii
SNPNYIPNI

SEQ ID NO: 211224 - protein, 9 aa, Borrelia garinii
NPNYIPNIS

SEQ ID NO: 211225 - protein, 9 aa, Borrelia garinii
PNYIPNISS

SEQ ID NO: 211226 - protein, 9 aa, Borrelia garinii
NYIPNISSR

SEQ ID NO: 211227 - protein, 9 aa, Borrelia garinii
YIPNISSRI

SEQ ID NO: 211228 - protein, 9 aa, Borrelia garinii
IPNISSRII

SEQ ID NO: 211229 - protein, 9 aa, Borrelia garinii
PNISSRIIK

SEQ ID NO: 211230 - protein, 9 aa, Borrelia garinii
NISSRIIKD

SEQ ID NO: 211231 - protein, 9 aa, Borrelia garinii
ISSRIIKDD

SEQ ID NO: 211232 - protein, 9 aa, Borrelia garinii
SSRIIKDDV

SEQ ID NO: 211233 - protein, 9 aa, Borrelia garinii
SRIIKDDVP

SEQ ID NO: 211234 - protein, 9 aa, Borrelia garinii
RIIKDDVPN

SEQ ID NO: 211235 - protein, 9 aa, Borrelia garinii
IIKDDVPNY

SEQ ID NO: 211236 - protein, 9 aa, Borrelia garinii
IKDDVPNYP

SEQ ID NO: 211237 - protein, 9 aa, Borrelia garinii
KDDVPNYPL

SEQ ID NO: 211238 - protein, 9 aa, Borrelia garinii
DDVPNYPLA

SEQ ID NO: 211239 - protein, 9 aa, Borrelia garinii
DVPNYPLAS

SEQ ID NO: 211240 - protein, 9 aa, Borrelia garinii
VPNYPLASS

SEQ ID NO: 211241 - protein, 9 aa, Borrelia garinii
PNYPLASSK

SEQ ID NO: 211242 - protein, 9 aa, Borrelia garinii
NYPLASSKM

SEQ ID NO: 211243 - protein, 9 aa, Borrelia garinii
YPLASSKMR

SEQ ID NO: 211244 - protein, 9 aa, Borrelia garinii
PLASSKMRF

SEQ ID NO: 211245 - protein, 9 aa, Borrelia garinii
LASSKMRFK

SEQ ID NO: 211246 - protein, 9 aa, Borrelia garinii
ASSKMRFKA

SEQ ID NO: 211247 - protein, 9 aa, Borrelia garinii
SSKMRFKAF

SEQ ID NO: 211248 - protein, 9 aa, Borrelia garinii
SKMRFKAFR

SEQ ID NO: 211249 - protein, 9 aa, Borrelia garinii
KMRFKAFRV

SEQ ID NO: 211250 - protein, 9 aa, Borrelia garinii
MRFKAFRVS

SEQ ID NO: 211251 - protein, 9 aa, Borrelia garinii
RFKAFRVSK

SEQ ID NO: 211252 - protein, 9 aa, Borrelia garinii
FKAFRVSKS

SEQ ID NO: 211253 - protein, 9 aa, Borrelia garinii
KAFRVSKSH

SEQ ID NO: 211254 - protein, 9 aa, Borrelia garinii
AFRVSKSHS

SEQ ID NO: 211255 - protein, 9 aa, Borrelia garinii
FRVSKSHSS

SEQ ID NO: 211256 - protein, 9 aa, Borrelia garinii
RVSKSHSSK

SEQ ID NO: 211257 - protein, 9 aa, Borrelia garinii
VSKSHSSKE

SEQ ID NO: 211258 - protein, 9 aa, Borrelia garinii
SKSHSSKEQ

SEQ ID NO: 211259 - protein, 9 aa, Borrelia garinii
KSHSSKEQN

SEQ ID NO: 211260 - protein, 9 aa, Borrelia garinii
SHSSKEQNF

SEQ ID NO: 211261 - protein, 9 aa, Borrelia garinii
HSSKEQNFI

SEQ ID NO: 211262 - protein, 9 aa, Borrelia garinii
SSKEQNFIF

SEQ ID NO: 211263 - protein, 9 aa, Borrelia garinii
SKEQNFIFY

SEQ ID NO: 211264 - protein, 9 aa, Borrelia garinii
KEQNFIFYV

SEQ ID NO: 211265 - protein, 9 aa, Borrelia garinii
EQNFIFYVK

SEQ ID NO: 211266 - protein, 9 aa, Borrelia garinii
QNFIFYVKD

SEQ ID NO: 211267 - protein, 9 aa, Borrelia garinii
NFIFYVKDL

SEQ ID NO: 211268 - protein, 9 aa, Borrelia garinii
FIFYVKDLR

SEQ ID NO: 211269 - protein, 9 aa, Borrelia garinii
IFYVKDLRV

SEQ ID NO: 211270 - protein, 9 aa, Borrelia garinii
FYVKDLRVL

SEQ ID NO: 211271 - protein, 9 aa, Borrelia garinii
YVKDLRVLY

SEQ ID NO: 211272 - protein, 9 aa, Borrelia garinii
VKDLRVLYD

SEQ ID NO: 211273 - protein, 9 aa, Borrelia garinii
KDLRVLYDK

SEQ ID NO: 211274 - protein, 9 aa, Borrelia garinii
DLRVLYDKL

SEQ ID NO: 211275 - protein, 9 aa, Borrelia garinii
LRVLYDKLS

SEQ ID NO: 211276 - protein, 9 aa, Borrelia garinii
RVLYDKLSV

SEQ ID NO: 211277 - protein, 9 aa, Borrelia garinii
VLYDKLSVS

SEQ ID NO: 211278 - protein, 9 aa, Borrelia garinii
LYDKLSVSI

SEQ ID NO: 211279 - protein, 9 aa, Borrelia garinii
YDKLSVSID

SEQ ID NO: 211280 - protein, 9 aa, Borrelia garinii
DKLSVSIDS

SEQ ID NO: 211281 - protein, 9 aa, Borrelia garinii
KLSVSIDSD

SEQ ID NO: 211282 - protein, 9 aa, Borrelia garinii
LSVSIDSDI

SEQ ID NO: 211283 - protein, 9 aa, Borrelia garinii
SVSIDSDID

SEQ ID NO: 211284 - protein, 9 aa, Borrelia garinii
VSIDSDIDS

SEQ ID NO: 211285 - protein, 9 aa, Borrelia garinii
SIDSDIDSE

SEQ ID NO: 211286 - protein, 9 aa, Borrelia garinii
IDSDIDSES

SEQ ID NO: 211287 - protein, 9 aa, Borrelia garinii
DSDIDSESV

SEQ ID NO: 211288 - protein, 9 aa, Borrelia garinii
SDIDSESVF

SEQ ID NO: 211289 - protein, 9 aa, Borrelia garinii
DIDSESVFK

SEQ ID NO: 211290 - protein, 9 aa, Borrelia garinii
IDSESVFKV

SEQ ID NO: 211291 - protein, 9 aa, Borrelia garinii
DSESVFKVY

SEQ ID NO: 211292 - protein, 9 aa, Borrelia garinii
SESVFKVYE

SEQ ID NO: 211293 - protein, 9 aa, Borrelia garinii
ESVFKVYET

SEQ ID NO: 211294 - protein, 9 aa, Borrelia garinii
SVFKVYETS

SEQ ID NO: 211295 - protein, 9 aa, Borrelia garinii
VFKVYETSG

SEQ ID NO: 211296 - protein, 9 aa, Borrelia garinii
FKVYETSGT

SEQ ID NO: 211297 - protein, 9 aa, Borrelia garinii
KVYETSGTE

SEQ ID NO: 211298 - protein, 9 aa, Borrelia garinii
VYETSGTES

SEQ ID NO: 211299 - protein, 9 aa, Borrelia garinii
YETSGTESL

SEQ ID NO: 211300 - protein, 9 aa, Borrelia garinii
ETSGTESLR

SEQ ID NO: 211301 - protein, 9 aa, Borrelia garinii
TSGTESLRK

SEQ ID NO: 211302 - protein, 9 aa, Borrelia garinii
SGTESLRKL

SEQ ID NO: 211303 - protein, 9 aa, Borrelia garinii
GTESLRKLK

SEQ ID NO: 211304 - protein, 9 aa, Borrelia garinii
TESLRKLKA

SEQ ID NO: 211305 - protein, 9 aa, Borrelia garinii
ESLRKLKAH

SEQ ID NO: 211306 - protein, 9 aa, Borrelia garinii
SLRKLKAHE

SEQ ID NO: 211307 - protein, 9 aa, Borrelia garinii
LRKLKAHET

SEQ ID NO: 211308 - protein, 9 aa, Borrelia garinii
RKLKAHETF

SEQ ID NO: 211309 - protein, 9 aa, Borrelia garinii
KLKAHETFK

SEQ ID NO: 211310 - protein, 9 aa, Borrelia garinii
LKAHETFKR

SEQ ID NO: 211311 - protein, 9 aa, Borrelia garinii
KAHETFKRV

SEQ ID NO: 211312 - protein, 9 aa, Borrelia garinii
AHETFKRVL

SEQ ID NO: 211313 - protein, 9 aa, Borrelia garinii
HETFKRVLK

SEQ ID NO: 211314 - protein, 9 aa, Borrelia garinii
ETFKRVLKL

SEQ ID NO: 211315 - protein, 9 aa, Borrelia garinii
TFKRVLKLR

SEQ ID NO: 211316 - protein, 9 aa, Borrelia garinii
FKRVLKLRE

SEQ ID NO: 211317 - protein, 9 aa, Borrelia garinii
KRVLKLREK

SEQ ID NO: 211318 - protein, 9 aa, Borrelia garinii
RVLKLREKI

SEQ ID NO: 211319 - protein, 9 aa, Borrelia garinii
VLKLREKIS

SEQ ID NO: 211320 - protein, 9 aa, Borrelia garinii
LKLREKISM

SEQ ID NO: 211321 - protein, 9 aa, Borrelia garinii
KLREKISMP

SEQ ID NO: 211322 - protein, 9 aa, Borrelia garinii
LREKISMPE

SEQ ID NO: 211323 - protein, 9 aa, Borrelia garinii
REKISMPEG

SEQ ID NO: 211324 - protein, 9 aa, Borrelia garinii
EKISMPEGS

SEQ ID NO: 211325 - protein, 9 aa, Borrelia garinii
KISMPEGSF

SEQ ID NO: 211326 - protein, 9 aa, Borrelia garinii
ISMPEGSFQ

SEQ ID NO: 211327 - protein, 9 aa, Borrelia garinii
SMPEGSFQN

SEQ ID NO: 211328 - protein, 9 aa, Borrelia garinii
MPEGSFQNF

SEQ ID NO: 211329 - protein, 9 aa, Borrelia garinii
PEGSFQNFI

SEQ ID NO: 211330 - protein, 9 aa, Borrelia garinii
EGSFQNFIE

SEQ ID NO: 211331 - protein, 9 aa, Borrelia garinii
GSFQNFIEK

SEQ ID NO: 211332 - protein, 9 aa, Borrelia garinii
SFQNFIEKV

SEQ ID NO: 211333 - protein, 9 aa, Borrelia garinii
FQNFIEKVE

SEQ ID NO: 211334 - protein, 9 aa, Borrelia garinii
QNFIEKVES

SEQ ID NO: 211335 - protein, 9 aa, Borrelia garinii
NFIEKVESE

SEQ ID NO: 211336 - protein, 9 aa, Borrelia garinii
FIEKVESEK

SEQ ID NO: 211337 - protein, 9 aa, Borrelia garinii
IEKVESEKK

SEQ ID NO: 211338 - protein, 9 aa, Borrelia garinii
EKVESEKKP

SEQ ID NO: 211339 - protein, 9 aa, Borrelia garinii
KVESEKKPE

SEQ ID NO: 211340 - protein, 9 aa, Borrelia garinii
VESEKKPEE

SEQ ID NO: 211341 - protein, 9 aa, Borrelia garinii
ESEKKPEES

SEQ ID NO: 211342 - protein, 9 aa, Borrelia garinii
SEKKPEESS

SEQ ID NO: 211343 - protein, 9 aa, Borrelia garinii
EKKPEESSL

SEQ ID NO: 211344 - protein, 9 aa, Borrelia garinii
KKPEESSLK

SEQ ID NO: 211345 - protein, 9 aa, Borrelia garinii
KPEESSLKK

SEQ ID NO: 211346 - protein, 10 aa, Borrelia garinii
MKRKAKSILL

SEQ ID NO: 211347 - protein, 10 aa, Borrelia garinii
KRKAKSILLF

SEQ ID NO: 211348 - protein, 10 aa, Borrelia garinii
RKAKSILLFL

SEQ ID NO: 211349 - protein, 10 aa, Borrelia garinii
KAKSILLFLL

SEQ ID NO: 211350 - protein, 10 aa, Borrelia garinii
AKSILLFLLS

SEQ ID NO: 211351 - protein, 10 aa, Borrelia garinii
KSILLFLLST

SEQ ID NO: 211352 - protein, 10 aa, Borrelia garinii
SILLFLLSTA

SEQ ID NO: 211353 - protein, 10 aa, Borrelia garinii
ILLFLLSTAL

SEQ ID NO: 211354 - protein, 10 aa, Borrelia garinii
LLFLLSTALF

SEQ ID NO: 211355 - protein, 10 aa, Borrelia garinii
LFLLSTALFA

SEQ ID NO: 211356 - protein, 10 aa, Borrelia garinii
FLLSTALFAQ

SEQ ID NO: 211357 - protein, 10 aa, Borrelia garinii
LLSTALFAQE

SEQ ID NO: 211358 - protein, 10 aa, Borrelia garinii
LSTALFAQET

SEQ ID NO: 211359 - protein, 10 aa, Borrelia garinii
STALFAQETD

SEQ ID NO: 211360 - protein, 10 aa, Borrelia garinii
TALFAQETDG

SEQ ID NO: 211361 - protein, 10 aa, Borrelia garinii
ALFAQETDGL

SEQ ID NO: 211362 - protein, 10 aa, Borrelia garinii
LFAQETDGLP

SEQ ID NO: 211363 - protein, 10 aa, Borrelia garinii
FAQETDGLPE

SEQ ID NO: 211364 - protein, 10 aa, Borrelia garinii
AQETDGLPEG

SEQ ID NO: 211365 - protein, 10 aa, Borrelia garinii
QETDGLPEGS

SEQ ID NO: 211366 - protein, 10 aa, Borrelia garinii
ETDGLPEGSK

SEQ ID NO: 211367 - protein, 10 aa, Borrelia garinii
TDGLPEGSKR

SEQ ID NO: 211368 - protein, 10 aa, Borrelia garinii
DGLPEGSKRS

SEQ ID NO: 211369 - protein, 10 aa, Borrelia garinii
GLPEGSKRSE

SEQ ID NO: 211370 - protein, 10 aa, Borrelia garinii
LPEGSKRSEP

SEQ ID NO: 211371 - protein, 10 aa, Borrelia garinii
PEGSKRSEPG

SEQ ID NO: 211372 - protein, 10 aa, Borrelia garinii
EGSKRSEPGE

SEQ ID NO: 211373 - protein, 10 aa, Borrelia garinii
GSKRSEPGEL

SEQ ID NO: 211374 - protein, 10 aa, Borrelia garinii
SKRSEPGELV

SEQ ID NO: 211375 - protein, 10 aa, Borrelia garinii
KRSEPGELVL

SEQ ID NO: 211376 - protein, 10 aa, Borrelia garinii
RSEPGELVLD

SEQ ID NO: 211377 - protein, 10 aa, Borrelia garinii
SEPGELVLDF

SEQ ID NO: 211378 - protein, 10 aa, Borrelia garinii
EPGELVLDFA

SEQ ID NO: 211379 - protein, 10 aa, Borrelia garinii
PGELVLDFAE

SEQ ID NO: 211380 - protein, 10 aa, Borrelia garinii
GELVLDFAEL

SEQ ID NO: 211381 - protein, 10 aa, Borrelia garinii
ELVLDFAELA

SEQ ID NO: 211382 - protein, 10 aa, Borrelia garinii
LVLDFAELAR

SEQ ID NO: 211383 - protein, 10 aa, Borrelia garinii
VLDFAELARD

SEQ ID NO: 211384 - protein, 10 aa, Borrelia garinii
LDFAELARDP

SEQ ID NO: 211385 - protein, 10 aa, Borrelia garinii
DFAELARDPS

SEQ ID NO: 211386 - protein, 10 aa, Borrelia garinii
FAELARDPSS

SEQ ID NO: 211387 - protein, 10 aa, Borrelia garinii
AELARDPSST

SEQ ID NO: 211388 - protein, 10 aa, Borrelia garinii
ELARDPSSTK

SEQ ID NO: 211389 - protein, 10 aa, Borrelia garinii
LARDPSSTKL

SEQ ID NO: 211390 - protein, 10 aa, Borrelia garinii
ARDPSSTKLD

SEQ ID NO: 211391 - protein, 10 aa, Borrelia garinii
RDPSSTKLDL

SEQ ID NO: 211392 - protein, 10 aa, Borrelia garinii
DPSSTKLDLT

SEQ ID NO: 211393 - protein, 10 aa, Borrelia garinii
PSSTKLDLTN

SEQ ID NO: 211394 - protein, 10 aa, Borrelia garinii
SSTKLDLTNY

SEQ ID NO: 211395 - protein, 10 aa, Borrelia garinii
STKLDLTNYV

SEQ ID NO: 211396 - protein, 10 aa, Borrelia garinii
TKLDLTNYVD

SEQ ID NO: 211397 - protein, 10 aa, Borrelia garinii
KLDLTNYVDY

SEQ ID NO: 211398 - protein, 10 aa, Borrelia garinii
LDLTNYVDYV

SEQ ID NO: 211399 - protein, 10 aa, Borrelia garinii
DLTNYVDYVY

SEQ ID NO: 211400 - protein, 10 aa, Borrelia garinii
LTNYVDYVYS

SEQ ID NO: 211401 - protein, 10 aa, Borrelia garinii
TNYVDYVYSG

SEQ ID NO: 211402 - protein, 10 aa, Borrelia garinii
NYVDYVYSGA

SEQ ID NO: 211403 - protein, 10 aa, Borrelia garinii
YVDYVYSGAS

SEQ ID NO: 211404 - protein, 10 aa, Borrelia garinii
VDYVYSGASG

SEQ ID NO: 211405 - protein, 10 aa, Borrelia garinii
DYVYSGASGI

SEQ ID NO: 211406 - protein, 10 aa, Borrelia garinii
YVYSGASGIV

SEQ ID NO: 211407 - protein, 10 aa, Borrelia garinii
VYSGASGIVK

SEQ ID NO: 211408 - protein, 10 aa, Borrelia garinii
YSGASGIVKP

SEQ ID NO: 211409 - protein, 10 aa, Borrelia garinii
SGASGIVKPE

SEQ ID NO: 211410 - protein, 10 aa, Borrelia garinii
GASGIVKPED

SEQ ID NO: 211411 - protein, 10 aa, Borrelia garinii
ASGIVKPEDM

SEQ ID NO: 211412 - protein, 10 aa, Borrelia garinii
SGIVKPEDMV

SEQ ID NO: 211413 - protein, 10 aa, Borrelia garinii
GIVKPEDMVV

SEQ ID NO: 211414 - protein, 10 aa, Borrelia garinii
IVKPEDMVVD

SEQ ID NO: 211415 - protein, 10 aa, Borrelia garinii
VKPEDMVVDL

SEQ ID NO: 211416 - protein, 10 aa, Borrelia garinii
KPEDMVVDLG

SEQ ID NO: 211417 - protein, 10 aa, Borrelia garinii
PEDMVVDLGI

SEQ ID NO: 211418 - protein, 10 aa, Borrelia garinii
EDMVVDLGIN

SEQ ID NO: 211419 - protein, 10 aa, Borrelia garinii
DMVVDLGINN

SEQ ID NO: 211420 - protein, 10 aa, Borrelia garinii
MVVDLGINNW

SEQ ID NO: 211421 - protein, 10 aa, Borrelia garinii
VVDLGINNWS

SEQ ID NO: 211422 - protein, 10 aa, Borrelia garinii
VDLGINNWSV

SEQ ID NO: 211423 - protein, 10 aa, Borrelia garinii
DLGINNWSVL

SEQ ID NO: 211424 - protein, 10 aa, Borrelia garinii
LGINNWSVLL

SEQ ID NO: 211425 - protein, 10 aa, Borrelia garinii
GINNWSVLLT

SEQ ID NO: 211426 - protein, 10 aa, Borrelia garinii
INNWSVLLTP

SEQ ID NO: 211427 - protein, 10 aa, Borrelia garinii
NNWSVLLTPS

SEQ ID NO: 211428 - protein, 10 aa, Borrelia garinii
NWSVLLTPSA

SEQ ID NO: 211429 - protein, 10 aa, Borrelia garinii
WSVLLTPSAR

SEQ ID NO: 211430 - protein, 10 aa, Borrelia garinii
SVLLTPSARL

SEQ ID NO: 211431 - protein, 10 aa, Borrelia garinii
VLLTPSARLQ

SEQ ID NO: 211432 - protein, 10 aa, Borrelia garinii
LLTPSARLQA

SEQ ID NO: 211433 - protein, 10 aa, Borrelia garinii
LTPSARLQAY

SEQ ID NO: 211434 - protein, 10 aa, Borrelia garinii
TPSARLQAYV

SEQ ID NO: 211435 - protein, 10 aa, Borrelia garinii
PSARLQAYVK

SEQ ID NO: 211436 - protein, 10 aa, Borrelia garinii
SARLQAYVKN

SEQ ID NO: 211437 - protein, 10 aa, Borrelia garinii
ARLQAYVKNS

SEQ ID NO: 211438 - protein, 10 aa, Borrelia garinii
RLQAYVKNSV

SEQ ID NO: 211439 - protein, 10 aa, Borrelia garinii
LQAYVKNSVV

SEQ ID NO: 211440 - protein, 10 aa, Borrelia garinii
QAYVKNSVVA

SEQ ID NO: 211441 - protein, 10 aa, Borrelia garinii
AYVKNSVVAP

SEQ ID NO: 211442 - protein, 10 aa, Borrelia garinii
YVKNSVVAPA

SEQ ID NO: 211443 - protein, 10 aa, Borrelia garinii
VKNSVVAPAV

SEQ ID NO: 211444 - protein, 10 aa, Borrelia garinii
KNSVVAPAVV

SEQ ID NO: 211445 - protein, 10 aa, Borrelia garinii
NSVVAPAVVK

SEQ ID NO: 211446 - protein, 10 aa, Borrelia garinii
SVVAPAVVKS

SEQ ID NO: 211447 - protein, 10 aa, Borrelia garinii
VVAPAVVKSE

SEQ ID NO: 211448 - protein, 10 aa, Borrelia garinii
VAPAVVKSES

SEQ ID NO: 211449 - protein, 10 aa, Borrelia garinii
APAVVKSESK

SEQ ID NO: 211450 - protein, 10 aa, Borrelia garinii
PAVVKSESKR

SEQ ID NO: 211451 - protein, 10 aa, Borrelia garinii
AVVKSESKRY

SEQ ID NO: 211452 - protein, 10 aa, Borrelia garinii
VVKSESKRYA

SEQ ID NO: 211453 - protein, 10 aa, Borrelia garinii
VKSESKRYAG

SEQ ID NO: 211454 - protein, 10 aa, Borrelia garinii
KSESKRYAGD

SEQ ID NO: 211455 - protein, 10 aa, Borrelia garinii
SESKRYAGDT

SEQ ID NO: 211456 - protein, 10 aa, Borrelia garinii
ESKRYAGDTI

SEQ ID NO: 211457 - protein, 10 aa, Borrelia garinii
SKRYAGDTIL

SEQ ID NO: 211458 - protein, 10 aa, Borrelia garinii
KRYAGDTILG

SEQ ID NO: 211459 - protein, 10 aa, Borrelia garinii
RYAGDTILGV

SEQ ID NO: 211460 - protein, 10 aa, Borrelia garinii
YAGDTILGVR

SEQ ID NO: 211461 - protein, 10 aa, Borrelia garinii
AGDTILGVRV

SEQ ID NO: 211462 - protein, 10 aa, Borrelia garinii
GDTILGVRVL

SEQ ID NO: 211463 - protein, 10 aa, Borrelia garinii
DTILGVRVLF

SEQ ID NO: 211464 - protein, 10 aa, Borrelia garinii
TILGVRVLFP

SEQ ID NO: 211465 - protein, 10 aa, Borrelia garinii
ILGVRVLFPS

SEQ ID NO: 211466 - protein, 10 aa, Borrelia garinii
LGVRVLFPSY

SEQ ID NO: 211467 - protein, 10 aa, Borrelia garinii
GVRVLFPSYS

SEQ ID NO: 211468 - protein, 10 aa, Borrelia garinii
VRVLFPSYSQ

SEQ ID NO: 211469 - protein, 10 aa, Borrelia garinii
RVLFPSYSQS

SEQ ID NO: 211470 - protein, 10 aa, Borrelia garinii
VLFPSYSQSS

SEQ ID NO: 211471 - protein, 10 aa, Borrelia garinii
LFPSYSQSSA

SEQ ID NO: 211472 - protein, 10 aa, Borrelia garinii
FPSYSQSSAM

SEQ ID NO: 211473 - protein, 10 aa, Borrelia garinii
PSYSQSSAMI

SEQ ID NO: 211474 - protein, 10 aa, Borrelia garinii
SYSQSSAMIM

SEQ ID NO: 211475 - protein, 10 aa, Borrelia garinii
YSQSSAMIMP

SEQ ID NO: 211476 - protein, 10 aa, Borrelia garinii
SQSSAMIMPP

SEQ ID NO: 211477 - protein, 10 aa, Borrelia garinii
QSSAMIMPPF

SEQ ID NO: 211478 - protein, 10 aa, Borrelia garinii
SSAMIMPPFK

SEQ ID NO: 211479 - protein, 10 aa, Borrelia garinii
SAMIMPPFKI

SEQ ID NO: 211480 - protein, 10 aa, Borrelia garinii
AMIMPPFKIP

SEQ ID NO: 211481 - protein, 10 aa, Borrelia garinii
MIMPPFKIPF

SEQ ID NO: 211482 - protein, 10 aa, Borrelia garinii
IMPPFKIPFY

SEQ ID NO: 211483 - protein, 10 aa, Borrelia garinii
MPPFKIPFYS

SEQ ID NO: 211484 - protein, 10 aa, Borrelia garinii
PPFKIPFYSG

SEQ ID NO: 211485 - protein, 10 aa, Borrelia garinii
PFKIPFYSGE

SEQ ID NO: 211486 - protein, 10 aa, Borrelia garinii
FKIPFYSGEN

SEQ ID NO: 211487 - protein, 10 aa, Borrelia garinii
KIPFYSGENG

SEQ ID NO: 211488 - protein, 10 aa, Borrelia garinii
IPFYSGENGN

SEQ ID NO: 211489 - protein, 10 aa, Borrelia garinii
PFYSGENGNQ

SEQ ID NO: 211490 - protein, 10 aa, Borrelia garinii
FYSGENGNQF

SEQ ID NO: 211491 - protein, 10 aa, Borrelia garinii
YSGENGNQFL

SEQ ID NO: 211492 - protein, 10 aa, Borrelia garinii
SGENGNQFLG

SEQ ID NO: 211493 - protein, 10 aa, Borrelia garinii
GENGNQFLGK

SEQ ID NO: 211494 - protein, 10 aa, Borrelia garinii
ENGNQFLGKG

SEQ ID NO: 211495 - protein, 10 aa, Borrelia garinii
NGNQFLGKGL

SEQ ID NO: 211496 - protein, 10 aa, Borrelia garinii
GNQFLGKGLI

SEQ ID NO: 211497 - protein, 10 aa, Borrelia garinii
NQFLGKGLIN

SEQ ID NO: 211498 - protein, 10 aa, Borrelia garinii
QFLGKGLINN

SEQ ID NO: 211499 - protein, 10 aa, Borrelia garinii
FLGKGLINNI

SEQ ID NO: 211500 - protein, 10 aa, Borrelia garinii
LGKGLINNIK

SEQ ID NO: 211501 - protein, 10 aa, Borrelia garinii
GKGLINNIKT

SEQ ID NO: 211502 - protein, 10 aa, Borrelia garinii
KGLINNIKTM

SEQ ID NO: 211503 - protein, 10 aa, Borrelia garinii
GLINNIKTMK

SEQ ID NO: 211504 - protein, 10 aa, Borrelia garinii
LINNIKTMKE

SEQ ID NO: 211505 - protein, 10 aa, Borrelia garinii
INNIKTMKEI

SEQ ID NO: 211506 - protein, 10 aa, Borrelia garinii
NNIKTMKEIK

SEQ ID NO: 211507 - protein, 10 aa, Borrelia garinii
NIKTMKEIKV

SEQ ID NO: 211508 - protein, 10 aa, Borrelia garinii
IKTMKEIKVS

SEQ ID NO: 211509 - protein, 10 aa, Borrelia garinii
KTMKEIKVSV

SEQ ID NO: 211510 - protein, 10 aa, Borrelia garinii
TMKEIKVSVY

SEQ ID NO: 211511 - protein, 10 aa, Borrelia garinii
MKEIKVSVYS

SEQ ID NO: 211512 - protein, 10 aa, Borrelia garinii
KEIKVSVYSL

SEQ ID NO: 211513 - protein, 10 aa, Borrelia garinii
EIKVSVYSLG

SEQ ID NO: 211514 - protein, 10 aa, Borrelia garinii
IKVSVYSLGY

SEQ ID NO: 211515 - protein, 10 aa, Borrelia garinii
KVSVYSLGYE

SEQ ID NO: 211516 - protein, 10 aa, Borrelia garinii
VSVYSLGYEI

SEQ ID NO: 211517 - protein, 10 aa, Borrelia garinii
SVYSLGYEID

SEQ ID NO: 211518 - protein, 10 aa, Borrelia garinii
VYSLGYEIDL

SEQ ID NO: 211519 - protein, 10 aa, Borrelia garinii
YSLGYEIDLE

SEQ ID NO: 211520 - protein, 10 aa, Borrelia garinii
SLGYEIDLEV

SEQ ID NO: 211521 - protein, 10 aa, Borrelia garinii
LGYEIDLEVL

SEQ ID NO: 211522 - protein, 10 aa, Borrelia garinii
GYEIDLEVLF

SEQ ID NO: 211523 - protein, 10 aa, Borrelia garinii
YEIDLEVLFE

SEQ ID NO: 211524 - protein, 10 aa, Borrelia garinii
EIDLEVLFED

SEQ ID NO: 211525 - protein, 10 aa, Borrelia garinii
IDLEVLFEDM

SEQ ID NO: 211526 - protein, 10 aa, Borrelia garinii
DLEVLFEDMN

SEQ ID NO: 211527 - protein, 10 aa, Borrelia garinii
LEVLFEDMNG

SEQ ID NO: 211528 - protein, 10 aa, Borrelia garinii
EVLFEDMNGM

SEQ ID NO: 211529 - protein, 10 aa, Borrelia garinii
VLFEDMNGME

SEQ ID NO: 211530 - protein, 10 aa, Borrelia garinii
LFEDMNGMEY

SEQ ID NO: 211531 - protein, 10 aa, Borrelia garinii
FEDMNGMEYA

SEQ ID NO: 211532 - protein, 10 aa, Borrelia garinii
EDMNGMEYAY

SEQ ID NO: 211533 - protein, 10 aa, Borrelia garinii
DMNGMEYAYS

SEQ ID NO: 211534 - protein, 10 aa, Borrelia garinii
MNGMEYAYSL

SEQ ID NO: 211535 - protein, 10 aa, Borrelia garinii
NGMEYAYSLG

SEQ ID NO: 211536 - protein, 10 aa, Borrelia garinii
GMEYAYSLGT

SEQ ID NO: 211537 - protein, 10 aa, Borrelia garinii
MEYAYSLGTL

SEQ ID NO: 211538 - protein, 10 aa, Borrelia garinii
EYAYSLGTLK

SEQ ID NO: 211539 - protein, 10 aa, Borrelia garinii
YAYSLGTLKF

SEQ ID NO: 211540 - protein, 10 aa, Borrelia garinii
AYSLGTLKFK

SEQ ID NO: 211541 - protein, 10 aa, Borrelia garinii
YSLGTLKFKG

SEQ ID NO: 211542 - protein, 10 aa, Borrelia garinii
SLGTLKFKGW

SEQ ID NO: 211543 - protein, 10 aa, Borrelia garinii
LGTLKFKGWA

SEQ ID NO: 211544 - protein, 10 aa, Borrelia garinii
GTLKFKGWAD

SEQ ID NO: 211545 - protein, 10 aa, Borrelia garinii
TLKFKGWADL

SEQ ID NO: 211546 - protein, 10 aa, Borrelia garinii
LKFKGWADLI

SEQ ID NO: 211547 - protein, 10 aa, Borrelia garinii
KFKGWADLIW

SEQ ID NO: 211548 - protein, 10 aa, Borrelia garinii
FKGWADLIWS

SEQ ID NO: 211549 - protein, 10 aa, Borrelia garinii
KGWADLIWSN

SEQ ID NO: 211550 - protein, 10 aa, Borrelia garinii
GWADLIWSNP

SEQ ID NO: 211551 - protein, 10 aa, Borrelia garinii
WADLIWSNPN

SEQ ID NO: 211552 - protein, 10 aa, Borrelia garinii
ADLIWSNPNY

SEQ ID NO: 211553 - protein, 10 aa, Borrelia garinii
DLIWSNPNYI

SEQ ID NO: 211554 - protein, 10 aa, Borrelia garinii
LIWSNPNYIP

SEQ ID NO: 211555 - protein, 10 aa, Borrelia garinii
IWSNPNYIPN

SEQ ID NO: 211556 - protein, 10 aa, Borrelia garinii
WSNPNYIPNI

SEQ ID NO: 211557 - protein, 10 aa, Borrelia garinii
SNPNYIPNIS

SEQ ID NO: 211558 - protein, 10 aa, Borrelia garinii
NPNYIPNISS

SEQ ID NO: 211559 - protein, 10 aa, Borrelia garinii
PNYIPNISSR

SEQ ID NO: 211560 - protein, 10 aa, Borrelia garinii
NYIPNISSRI

SEQ ID NO: 211561 - protein, 10 aa, Borrelia garinii
YIPNISSRII

SEQ ID NO: 211562 - protein, 10 aa, Borrelia garinii
IPNISSRIIK

SEQ ID NO: 211563 - protein, 10 aa, Borrelia garinii
PNISSRIIKD

SEQ ID NO: 211564 - protein, 10 aa, Borrelia garinii
NISSRIIKDD

SEQ ID NO: 211565 - protein, 10 aa, Borrelia garinii
ISSRIIKDDV

SEQ ID NO: 211566 - protein, 10 aa, Borrelia garinii
SSRIIKDDVP

SEQ ID NO: 211567 - protein, 10 aa, Borrelia garinii
SRIIKDDVPN

SEQ ID NO: 211568 - protein, 10 aa, Borrelia garinii
RIIKDDVPNY

SEQ ID NO: 211569 - protein, 10 aa, Borrelia garinii
IIKDDVPNYP

SEQ ID NO: 211570 - protein, 10 aa, Borrelia garinii
IKDDVPNYPL

SEQ ID NO: 211571 - protein, 10 aa, Borrelia garinii
KDDVPNYPLA

SEQ ID NO: 211572 - protein, 10 aa, Borrelia garinii
DDVPNYPLAS

SEQ ID NO: 211573 - protein, 10 aa, Borrelia garinii
DVPNYPLASS

SEQ ID NO: 211574 - protein, 10 aa, Borrelia garinii
VPNYPLASSK

SEQ ID NO: 211575 - protein, 10 aa, Borrelia garinii
PNYPLASSKM

SEQ ID NO: 211576 - protein, 10 aa, Borrelia garinii
NYPLASSKMR

SEQ ID NO: 211577 - protein, 10 aa, Borrelia garinii
YPLASSKMRF

SEQ ID NO: 211578 - protein, 10 aa, Borrelia garinii
PLASSKMRFK

SEQ ID NO: 211579 - protein, 10 aa, Borrelia garinii
LASSKMRFKA

SEQ ID NO: 211580 - protein, 10 aa, Borrelia garinii
ASSKMRFKAF

SEQ ID NO: 211581 - protein, 10 aa, Borrelia garinii
SSKMRFKAFR

SEQ ID NO: 211582 - protein, 10 aa, Borrelia garinii
SKMRFKAFRV

SEQ ID NO: 211583 - protein, 10 aa, Borrelia garinii
KMRFKAFRVS

SEQ ID NO: 211584 - protein, 10 aa, Borrelia garinii
MRFKAFRVSK

SEQ ID NO: 211585 - protein, 10 aa, Borrelia garinii
RFKAFRVSKS

SEQ ID NO: 211586 - protein, 10 aa, Borrelia garinii
FKAFRVSKSH

SEQ ID NO: 211587 - protein, 10 aa, Borrelia garinii
KAFRVSKSHS

SEQ ID NO: 211588 - protein, 10 aa, Borrelia garinii
AFRVSKSHSS

SEQ ID NO: 211589 - protein, 10 aa, Borrelia garinii
FRVSKSHSSK

SEQ ID NO: 211590 - protein, 10 aa, Borrelia garinii
RVSKSHSSKE

SEQ ID NO: 211591 - protein, 10 aa, Borrelia garinii
VSKSHSSKEQ

SEQ ID NO: 211592 - protein, 10 aa, Borrelia garinii
SKSHSSKEQN

SEQ ID NO: 211593 - protein, 10 aa, Borrelia garinii
KSHSSKEQNF

SEQ ID NO: 211594 - protein, 10 aa, Borrelia garinii
SHSSKEQNFI

SEQ ID NO: 211595 - protein, 10 aa, Borrelia garinii
HSSKEQNFIF

SEQ ID NO: 211596 - protein, 10 aa, Borrelia garinii
SSKEQNFIFY

SEQ ID NO: 211597 - protein, 10 aa, Borrelia garinii
SKEQNFIFYV

SEQ ID NO: 211598 - protein, 10 aa, Borrelia garinii
KEQNFIFYVK

SEQ ID NO: 211599 - protein, 10 aa, Borrelia garinii
EQNFIFYVKD

SEQ ID NO: 211600 - protein, 10 aa, Borrelia garinii
QNFIFYVKDL

SEQ ID NO: 211601 - protein, 10 aa, Borrelia garinii
NFIFYVKDLR

SEQ ID NO: 211602 - protein, 10 aa, Borrelia garinii
FIFYVKDLRV

SEQ ID NO: 211603 - protein, 10 aa, Borrelia garinii
IFYVKDLRVL

SEQ ID NO: 211604 - protein, 10 aa, Borrelia garinii
FYVKDLRVLY

SEQ ID NO: 211605 - protein, 10 aa, Borrelia garinii
YVKDLRVLYD

SEQ ID NO: 211606 - protein, 10 aa, Borrelia garinii
VKDLRVLYDK

SEQ ID NO: 211607 - protein, 10 aa, Borrelia garinii
KDLRVLYDKL

SEQ ID NO: 211608 - protein, 10 aa, Borrelia garinii
DLRVLYDKLS

SEQ ID NO: 211609 - protein, 10 aa, Borrelia garinii
LRVLYDKLSV

SEQ ID NO: 211610 - protein, 10 aa, Borrelia garinii
RVLYDKLSVS

SEQ ID NO: 211611 - protein, 10 aa, Borrelia garinii
VLYDKLSVSI

SEQ ID NO: 211612 - protein, 10 aa, Borrelia garinii
LYDKLSVSID

SEQ ID NO: 211613 - protein, 10 aa, Borrelia garinii
YDKLSVSIDS

SEQ ID NO: 211614 - protein, 10 aa, Borrelia garinii
DKLSVSIDSD

SEQ ID NO: 211615 - protein, 10 aa, Borrelia garinii
KLSVSIDSDI

SEQ ID NO: 211616 - protein, 10 aa, Borrelia garinii
LSVSIDSDID

SEQ ID NO: 211617 - protein, 10 aa, Borrelia garinii
SVSIDSDIDS

SEQ ID NO: 211618 - protein, 10 aa, Borrelia garinii
VSIDSDIDSE

SEQ ID NO: 211619 - protein, 10 aa, Borrelia garinii
SIDSDIDSES

SEQ ID NO: 211620 - protein, 10 aa, Borrelia garinii
IDSDIDSESV

SEQ ID NO: 211621 - protein, 10 aa, Borrelia garinii
DSDIDSESVF

SEQ ID NO: 211622 - protein, 10 aa, Borrelia garinii
SDIDSESVFK

SEQ ID NO: 211623 - protein, 10 aa, Borrelia garinii
DIDSESVFKV

SEQ ID NO: 211624 - protein, 10 aa, Borrelia garinii
IDSESVFKVY

SEQ ID NO: 211625 - protein, 10 aa, Borrelia garinii
DSESVFKVYE

SEQ ID NO: 211626 - protein, 10 aa, Borrelia garinii
SESVFKVYET

SEQ ID NO: 211627 - protein, 10 aa, Borrelia garinii
ESVFKVYETS

SEQ ID NO: 211628 - protein, 10 aa, Borrelia garinii
SVFKVYETSG

SEQ ID NO: 211629 - protein, 10 aa, Borrelia garinii
VFKVYETSGT

SEQ ID NO: 211630 - protein, 10 aa, Borrelia garinii
FKVYETSGTE

SEQ ID NO: 211631 - protein, 10 aa, Borrelia garinii
KVYETSGTES

SEQ ID NO: 211632 - protein, 10 aa, Borrelia garinii
VYETSGTESL

SEQ ID NO: 211633 - protein, 10 aa, Borrelia garinii
YETSGTESLR

SEQ ID NO: 211634 - protein, 10 aa, Borrelia garinii
ETSGTESLRK

SEQ ID NO: 211635 - protein, 10 aa, Borrelia garinii
TSGTESLRKL

SEQ ID NO: 211636 - protein, 10 aa, Borrelia garinii
SGTESLRKLK

SEQ ID NO: 211637 - protein, 10 aa, Borrelia garinii
GTESLRKLKA

SEQ ID NO: 211638 - protein, 10 aa, Borrelia garinii
TESLRKLKAH

SEQ ID NO: 211639 - protein, 10 aa, Borrelia garinii
ESLRKLKAHE

SEQ ID NO: 211640 - protein, 10 aa, Borrelia garinii
SLRKLKAHET

SEQ ID NO: 211641 - protein, 10 aa, Borrelia garinii
LRKLKAHETF

SEQ ID NO: 211642 - protein, 10 aa, Borrelia garinii
RKLKAHETFK

SEQ ID NO: 211643 - protein, 10 aa, Borrelia garinii
KLKAHETFKR

SEQ ID NO: 211644 - protein, 10 aa, Borrelia garinii
LKAHETFKRV

SEQ ID NO: 211645 - protein, 10 aa, Borrelia garinii
KAHETFKRVL

SEQ ID NO: 211646 - protein, 10 aa, Borrelia garinii
AHETFKRVLK

SEQ ID NO: 211647 - protein, 10 aa, Borrelia garinii
HETFKRVLKL

SEQ ID NO: 211648 - protein, 10 aa, Borrelia garinii
ETFKRVLKLR

SEQ ID NO: 211649 - protein, 10 aa, Borrelia garinii
TFKRVLKLRE

SEQ ID NO: 211650 - protein, 10 aa, Borrelia garinii
FKRVLKLREK

SEQ ID NO: 211651 - protein, 10 aa, Borrelia garinii
KRVLKLREKI

SEQ ID NO: 211652 - protein, 10 aa, Borrelia garinii
RVLKLREKIS

SEQ ID NO: 211653 - protein, 10 aa, Borrelia garinii
VLKLREKISM

SEQ ID NO: 211654 - protein, 10 aa, Borrelia garinii
LKLREKISMP

SEQ ID NO: 211655 - protein, 10 aa, Borrelia garinii
KLREKISMPE

SEQ ID NO: 211656 - protein, 10 aa, Borrelia garinii
LREKISMPEG

SEQ ID NO: 211657 - protein, 10 aa, Borrelia garinii
REKISMPEGS

SEQ ID NO: 211658 - protein, 10 aa, Borrelia garinii
EKISMPEGSF

SEQ ID NO: 211659 - protein, 10 aa, Borrelia garinii
KISMPEGSFQ

SEQ ID NO: 211660 - protein, 10 aa, Borrelia garinii
ISMPEGSFQN

SEQ ID NO: 211661 - protein, 10 aa, Borrelia garinii
SMPEGSFQNF

SEQ ID NO: 211662 - protein, 10 aa, Borrelia garinii
MPEGSFQNFI

SEQ ID NO: 211663 - protein, 10 aa, Borrelia garinii
PEGSFQNFIE

SEQ ID NO: 211664 - protein, 10 aa, Borrelia garinii
EGSFQNFIEK

SEQ ID NO: 211665 - protein, 10 aa, Borrelia garinii
GSFQNFIEKV

SEQ ID NO: 211666 - protein, 10 aa, Borrelia garinii
SFQNFIEKVE

SEQ ID NO: 211667 - protein, 10 aa, Borrelia garinii
FQNFIEKVES

SEQ ID NO: 211668 - protein, 10 aa, Borrelia garinii
QNFIEKVESE

SEQ ID NO: 211669 - protein, 10 aa, Borrelia garinii
NFIEKVESEK

SEQ ID NO: 211670 - protein, 10 aa, Borrelia garinii
FIEKVESEKK

SEQ ID NO: 211671 - protein, 10 aa, Borrelia garinii
IEKVESEKKP

SEQ ID NO: 211672 - protein, 10 aa, Borrelia garinii
EKVESEKKPE

SEQ ID NO: 211673 - protein, 10 aa, Borrelia garinii
KVESEKKPEE

SEQ ID NO: 211674 - protein, 10 aa, Borrelia garinii
VESEKKPEES

SEQ ID NO: 211675 - protein, 10 aa, Borrelia garinii
ESEKKPEESS

SEQ ID NO: 211676 - protein, 10 aa, Borrelia garinii
SEKKPEESSL

SEQ ID NO: 211677 - protein, 10 aa, Borrelia garinii
EKKPEESSLK

SEQ ID NO: 211678 - protein, 10 aa, Borrelia garinii
KKPEESSLKK

SEQ ID NO: 211679 - protein, 11 aa, Borrelia garinii
MKRKAKSILLF

SEQ ID NO: 211680 - protein, 11 aa, Borrelia garinii
KRKAKSILLFL

SEQ ID NO: 211681 - protein, 11 aa, Borrelia garinii
RKAKSILLFLL

SEQ ID NO: 211682 - protein, 11 aa, Borrelia garinii
KAKSILLFLLS

SEQ ID NO: 211683 - protein, 11 aa, Borrelia garinii
AKSILLFLLST

SEQ ID NO: 211684 - protein, 11 aa, Borrelia garinii
KSILLFLLSTA

SEQ ID NO: 211685 - protein, 11 aa, Borrelia garinii
SILLFLLSTAL

SEQ ID NO: 211686 - protein, 11 aa, Borrelia garinii
ILLFLLSTALF

SEQ ID NO: 211687 - protein, 11 aa, Borrelia garinii
LLFLLSTALFA

SEQ ID NO: 211688 - protein, 11 aa, Borrelia garinii
LFLLSTALFAQ

SEQ ID NO: 211689 - protein, 11 aa, Borrelia garinii
FLLSTALFAQE

SEQ ID NO: 211690 - protein, 11 aa, Borrelia garinii
LLSTALFAQET

SEQ ID NO: 211691 - protein, 11 aa, Borrelia garinii
LSTALFAQETD

SEQ ID NO: 211692 - protein, 11 aa, Borrelia garinii
STALFAQETDG

SEQ ID NO: 211693 - protein, 11 aa, Borrelia garinii
TALFAQETDGL

SEQ ID NO: 211694 - protein, 11 aa, Borrelia garinii
ALFAQETDGLP

SEQ ID NO: 211695 - protein, 11 aa, Borrelia garinii
LFAQETDGLPE

SEQ ID NO: 211696 - protein, 11 aa, Borrelia garinii
FAQETDGLPEG

SEQ ID NO: 211697 - protein, 11 aa, Borrelia garinii
AQETDGLPEGS

SEQ ID NO: 211698 - protein, 11 aa, Borrelia garinii
QETDGLPEGSK

SEQ ID NO: 211699 - protein, 11 aa, Borrelia garinii
ETDGLPEGSKR

SEQ ID NO: 211700 - protein, 11 aa, Borrelia garinii
TDGLPEGSKRS

SEQ ID NO: 211701 - protein, 11 aa, Borrelia garinii
DGLPEGSKRSE

SEQ ID NO: 211702 - protein, 11 aa, Borrelia garinii
GLPEGSKRSEP

SEQ ID NO: 211703 - protein, 11 aa, Borrelia garinii
LPEGSKRSEPG

SEQ ID NO: 211704 - protein, 11 aa, Borrelia garinii
PEGSKRSEPGE

SEQ ID NO: 211705 - protein, 11 aa, Borrelia garinii
EGSKRSEPGEL

SEQ ID NO: 211706 - protein, 11 aa, Borrelia garinii
GSKRSEPGELV

SEQ ID NO: 211707 - protein, 11 aa, Borrelia garinii
SKRSEPGELVL

SEQ ID NO: 211708 - protein, 11 aa, Borrelia garinii
KRSEPGELVLD

SEQ ID NO: 211709 - protein, 11 aa, Borrelia garinii
RSEPGELVLDF

SEQ ID NO: 211710 - protein, 11 aa, Borrelia garinii
SEPGELVLDFA

SEQ ID NO: 211711 - protein, 11 aa, Borrelia garinii
EPGELVLDFAE

SEQ ID NO: 211712 - protein, 11 aa, Borrelia garinii
PGELVLDFAEL

SEQ ID NO: 211713 - protein, 11 aa, Borrelia garinii
GELVLDFAELA

SEQ ID NO: 211714 - protein, 11 aa, Borrelia garinii
ELVLDFAELAR

SEQ ID NO: 211715 - protein, 11 aa, Borrelia garinii
LVLDFAELARD

SEQ ID NO: 211716 - protein, 11 aa, Borrelia garinii
VLDFAELARDP

SEQ ID NO: 211717 - protein, 11 aa, Borrelia garinii
LDFAELARDPS

SEQ ID NO: 211718 - protein, 11 aa, Borrelia garinii
DFAELARDPSS

SEQ ID NO: 211719 - protein, 11 aa, Borrelia garinii
FAELARDPSST

SEQ ID NO: 211720 - protein, 11 aa, Borrelia garinii
AELARDPSSTK

SEQ ID NO: 211721 - protein, 11 aa, Borrelia garinii
ELARDPSSTKL

SEQ ID NO: 211722 - protein, 11 aa, Borrelia garinii
LARDPSSTKLD

SEQ ID NO: 211723 - protein, 11 aa, Borrelia garinii
ARDPSSTKLDL

SEQ ID NO: 211724 - protein, 11 aa, Borrelia garinii
RDPSSTKLDLT

SEQ ID NO: 211725 - protein, 11 aa, Borrelia garinii
DPSSTKLDLTN

SEQ ID NO: 211726 - protein, 11 aa, Borrelia garinii
PSSTKLDLTNY

SEQ ID NO: 211727 - protein, 11 aa, Borrelia garinii
SSTKLDLTNYV

SEQ ID NO: 211728 - protein, 11 aa, Borrelia garinii
STKLDLTNYVD

SEQ ID NO: 211729 - protein, 11 aa, Borrelia garinii
TKLDLTNYVDY

SEQ ID NO: 211730 - protein, 11 aa, Borrelia garinii
KLDLTNYVDYV

SEQ ID NO: 211731 - protein, 11 aa, Borrelia garinii
LDLTNYVDYVY

SEQ ID NO: 211732 - protein, 11 aa, Borrelia garinii
DLTNYVDYVYS

SEQ ID NO: 211733 - protein, 11 aa, Borrelia garinii
LTNYVDYVYSG

SEQ ID NO: 211734 - protein, 11 aa, Borrelia garinii
TNYVDYVYSGA

SEQ ID NO: 211735 - protein, 11 aa, Borrelia garinii
NYVDYVYSGAS

SEQ ID NO: 211736 - protein, 11 aa, Borrelia garinii
YVDYVYSGASG

SEQ ID NO: 211737 - protein, 11 aa, Borrelia garinii
VDYVYSGASGI

SEQ ID NO: 211738 - protein, 11 aa, Borrelia garinii
DYVYSGASGIV

SEQ ID NO: 211739 - protein, 11 aa, Borrelia garinii
YVYSGASGIVK

SEQ ID NO: 211740 - protein, 11 aa, Borrelia garinii
VYSGASGIVKP

SEQ ID NO: 211741 - protein, 11 aa, Borrelia garinii
YSGASGIVKPE

SEQ ID NO: 211742 - protein, 11 aa, Borrelia garinii
SGASGIVKPED

SEQ ID NO: 211743 - protein, 11 aa, Borrelia garinii
GASGIVKPEDM

SEQ ID NO: 211744 - protein, 11 aa, Borrelia garinii
ASGIVKPEDMV

SEQ ID NO: 211745 - protein, 11 aa, Borrelia garinii
SGIVKPEDMVV

SEQ ID NO: 211746 - protein, 11 aa, Borrelia garinii
GIVKPEDMVVD

SEQ ID NO: 211747 - protein, 11 aa, Borrelia garinii
IVKPEDMVVDL

SEQ ID NO: 211748 - protein, 11 aa, Borrelia garinii
VKPEDMVVDLG

SEQ ID NO: 211749 - protein, 11 aa, Borrelia garinii
KPEDMVVDLGI

SEQ ID NO: 211750 - protein, 11 aa, Borrelia garinii
PEDMVVDLGIN

SEQ ID NO: 211751 - protein, 11 aa, Borrelia garinii
EDMVVDLGINN

SEQ ID NO: 211752 - protein, 11 aa, Borrelia garinii
DMVVDLGINNW

SEQ ID NO: 211753 - protein, 11 aa, Borrelia garinii
MVVDLGINNWS

SEQ ID NO: 211754 - protein, 11 aa, Borrelia garinii
VVDLGINNWSV

SEQ ID NO: 211755 - protein, 11 aa, Borrelia garinii
VDLGINNWSVL

SEQ ID NO: 211756 - protein, 11 aa, Borrelia garinii
DLGINNWSVLL

SEQ ID NO: 211757 - protein, 11 aa, Borrelia garinii
LGINNWSVLLT

SEQ ID NO: 211758 - protein, 11 aa, Borrelia garinii
GINNWSVLLTP

SEQ ID NO: 211759 - protein, 11 aa, Borrelia garinii
INNWSVLLTPS

SEQ ID NO: 211760 - protein, 11 aa, Borrelia garinii
NNWSVLLTPSA

SEQ ID NO: 211761 - protein, 11 aa, Borrelia garinii
NWSVLLTPSAR

SEQ ID NO: 211762 - protein, 11 aa, Borrelia garinii
WSVLLTPSARL

SEQ ID NO: 211763 - protein, 11 aa, Borrelia garinii
SVLLTPSARLQ

SEQ ID NO: 211764 - protein, 11 aa, Borrelia garinii
VLLTPSARLQA

SEQ ID NO: 211765 - protein, 11 aa, Borrelia garinii
LLTPSARLQAY

SEQ ID NO: 211766 - protein, 11 aa, Borrelia garinii
LTPSARLQAYV

SEQ ID NO: 211767 - protein, 11 aa, Borrelia garinii
TPSARLQAYVK

SEQ ID NO: 211768 - protein, 11 aa, Borrelia garinii
PSARLQAYVKN

SEQ ID NO: 211769 - protein, 11 aa, Borrelia garinii
SARLQAYVKNS

SEQ ID NO: 211770 - protein, 11 aa, Borrelia garinii
ARLQAYVKNSV

SEQ ID NO: 211771 - protein, 11 aa, Borrelia garinii
RLQAYVKNSVV

SEQ ID NO: 211772 - protein, 11 aa, Borrelia garinii
LQAYVKNSVVA

SEQ ID NO: 211773 - protein, 11 aa, Borrelia garinii
QAYVKNSVVAP

SEQ ID NO: 211774 - protein, 11 aa, Borrelia garinii
AYVKNSVVAPA

SEQ ID NO: 211775 - protein, 11 aa, Borrelia garinii
YVKNSVVAPAV

SEQ ID NO: 211776 - protein, 11 aa, Borrelia garinii
VKNSVVAPAVV

SEQ ID NO: 211777 - protein, 11 aa, Borrelia garinii
KNSVVAPAVVK

SEQ ID NO: 211778 - protein, 11 aa, Borrelia garinii
NSVVAPAVVKS

SEQ ID NO: 211779 - protein, 11 aa, Borrelia garinii
SVVAPAVVKSE

SEQ ID NO: 211780 - protein, 11 aa, Borrelia garinii
VVAPAVVKSES

SEQ ID NO: 211781 - protein, 11 aa, Borrelia garinii
VAPAVVKSESK

SEQ ID NO: 211782 - protein, 11 aa, Borrelia garinii
APAVVKSESKR

SEQ ID NO: 211783 - protein, 11 aa, Borrelia garinii
PAVVKSESKRY

SEQ ID NO: 211784 - protein, 11 aa, Borrelia garinii
AVVKSESKRYA

SEQ ID NO: 211785 - protein, 11 aa, Borrelia garinii
VVKSESKRYAG

SEQ ID NO: 211786 - protein, 11 aa, Borrelia garinii
VKSESKRYAGD

SEQ ID NO: 211787 - protein, 11 aa, Borrelia garinii
KSESKRYAGDT

SEQ ID NO: 211788 - protein, 11 aa, Borrelia garinii
SESKRYAGDTI

SEQ ID NO: 211789 - protein, 11 aa, Borrelia garinii
ESKRYAGDTIL

SEQ ID NO: 211790 - protein, 11 aa, Borrelia garinii
SKRYAGDTILG

SEQ ID NO: 211791 - protein, 11 aa, Borrelia garinii
KRYAGDTILGV

SEQ ID NO: 211792 - protein, 11 aa, Borrelia garinii
RYAGDTILGVR

SEQ ID NO: 211793 - protein, 11 aa, Borrelia garinii
YAGDTILGVRV

SEQ ID NO: 211794 - protein, 11 aa, Borrelia garinii
AGDTILGVRVL

SEQ ID NO: 211795 - protein, 11 aa, Borrelia garinii
GDTILGVRVLF

SEQ ID NO: 211796 - protein, 11 aa, Borrelia garinii
DTILGVRVLFP

SEQ ID NO: 211797 - protein, 11 aa, Borrelia garinii
TILGVRVLFPS

SEQ ID NO: 211798 - protein, 11 aa, Borrelia garinii
ILGVRVLFPSY

SEQ ID NO: 211799 - protein, 11 aa, Borrelia garinii
LGVRVLFPSYS

SEQ ID NO: 211800 - protein, 11 aa, Borrelia garinii
GVRVLFPSYSQ

SEQ ID NO: 211801 - protein, 11 aa, Borrelia garinii
VRVLFPSYSQS

SEQ ID NO: 211802 - protein, 11 aa, Borrelia garinii
RVLFPSYSQSS

SEQ ID NO: 211803 - protein, 11 aa, Borrelia garinii
VLFPSYSQSSA

SEQ ID NO: 211804 - protein, 11 aa, Borrelia garinii
LFPSYSQSSAM

SEQ ID NO: 211805 - protein, 11 aa, Borrelia garinii
FPSYSQSSAMI

SEQ ID NO: 211806 - protein, 11 aa, Borrelia garinii
PSYSQSSAMIM

SEQ ID NO: 211807 - protein, 11 aa, Borrelia garinii
SYSQSSAMIMP

SEQ ID NO: 211808 - protein, 11 aa, Borrelia garinii
YSQSSAMIMPP

SEQ ID NO: 211809 - protein, 11 aa, Borrelia garinii
SQSSAMIMPPF

SEQ ID NO: 211810 - protein, 11 aa, Borrelia garinii
QSSAMIMPPFK

SEQ ID NO: 211811 - protein, 11 aa, Borrelia garinii
SSAMIMPPFKI

SEQ ID NO: 211812 - protein, 11 aa, Borrelia garinii
SAMIMPPFKIP

SEQ ID NO: 211813 - protein, 11 aa, Borrelia garinii
AMIMPPFKIPF

SEQ ID NO: 211814 - protein, 11 aa, Borrelia garinii
MIMPPFKIPFY

SEQ ID NO: 211815 - protein, 11 aa, Borrelia garinii
IMPPFKIPFYS

SEQ ID NO: 211816 - protein, 11 aa, Borrelia garinii
MPPFKIPFYSG

SEQ ID NO: 211817 - protein, 11 aa, Borrelia garinii
PPFKIPFYSGE

SEQ ID NO: 211818 - protein, 11 aa, Borrelia garinii
PFKIPFYSGEN

SEQ ID NO: 211819 - protein, 11 aa, Borrelia garinii
FKIPFYSGENG

SEQ ID NO: 211820 - protein, 11 aa, Borrelia garinii
KIPFYSGENGN

SEQ ID NO: 211821 - protein, 11 aa, Borrelia garinii
IPFYSGENGNQ

SEQ ID NO: 211822 - protein, 11 aa, Borrelia garinii
PFYSGENGNQF

SEQ ID NO: 211823 - protein, 11 aa, Borrelia garinii
FYSGENGNQFL

SEQ ID NO: 211824 - protein, 11 aa, Borrelia garinii
YSGENGNQFLG

SEQ ID NO: 211825 - protein, 11 aa, Borrelia garinii
SGENGNQFLGK

SEQ ID NO: 211826 - protein, 11 aa, Borrelia garinii
GENGNQFLGKG

SEQ ID NO: 211827 - protein, 11 aa, Borrelia garinii
ENGNQFLGKGL

SEQ ID NO: 211828 - protein, 11 aa, Borrelia garinii
NGNQFLGKGLI

SEQ ID NO: 211829 - protein, 11 aa, Borrelia garinii
GNQFLGKGLIN

SEQ ID NO: 211830 - protein, 11 aa, Borrelia garinii
NQFLGKGLINN

SEQ ID NO: 211831 - protein, 11 aa, Borrelia garinii
QFLGKGLINNI

SEQ ID NO: 211832 - protein, 11 aa, Borrelia garinii
FLGKGLINNIK

SEQ ID NO: 211833 - protein, 11 aa, Borrelia garinii
LGKGLINNIKT

SEQ ID NO: 211834 - protein, 11 aa, Borrelia garinii
GKGLINNIKTM

SEQ ID NO: 211835 - protein, 11 aa, Borrelia garinii
KGLINNIKTMK

SEQ ID NO: 211836 - protein, 11 aa, Borrelia garinii
GLINNIKTMKE

SEQ ID NO: 211837 - protein, 11 aa, Borrelia garinii
LINNIKTMKEI

SEQ ID NO: 211838 - protein, 11 aa, Borrelia garinii
INNIKTMKEIK

SEQ ID NO: 211839 - protein, 11 aa, Borrelia garinii
NNIKTMKEIKV

SEQ ID NO: 211840 - protein, 11 aa, Borrelia garinii
NIKTMKEIKVS

SEQ ID NO: 211841 - protein, 11 aa, Borrelia garinii
IKTMKEIKVSV

SEQ ID NO: 211842 - protein, 11 aa, Borrelia garinii
KTMKEIKVSVY

SEQ ID NO: 211843 - protein, 11 aa, Borrelia garinii
TMKEIKVSVYS

SEQ ID NO: 211844 - protein, 11 aa, Borrelia garinii
MKEIKVSVYSL

SEQ ID NO: 211845 - protein, 11 aa, Borrelia garinii
KEIKVSVYSLG

SEQ ID NO: 211846 - protein, 11 aa, Borrelia garinii
EIKVSVYSLGY

SEQ ID NO: 211847 - protein, 11 aa, Borrelia garinii
IKVSVYSLGYE

SEQ ID NO: 211848 - protein, 11 aa, Borrelia garinii
KVSVYSLGYEI

SEQ ID NO: 211849 - protein, 11 aa, Borrelia garinii
VSVYSLGYEID

SEQ ID NO: 211850 - protein, 11 aa, Borrelia garinii
SVYSLGYEIDL

SEQ ID NO: 211851 - protein, 11 aa, Borrelia garinii
VYSLGYEIDLE

SEQ ID NO: 211852 - protein, 11 aa, Borrelia garinii
YSLGYEIDLEV

SEQ ID NO: 211853 - protein, 11 aa, Borrelia garinii
SLGYEIDLEVL

SEQ ID NO: 211854 - protein, 11 aa, Borrelia garinii
LGYEIDLEVLF

SEQ ID NO: 211855 - protein, 11 aa, Borrelia garinii
GYEIDLEVLFE

SEQ ID NO: 211856 - protein, 11 aa, Borrelia garinii
YEIDLEVLFED

SEQ ID NO: 211857 - protein, 11 aa, Borrelia garinii
EIDLEVLFEDM

SEQ ID NO: 211858 - protein, 11 aa, Borrelia garinii
IDLEVLFEDMN

SEQ ID NO: 211859 - protein, 11 aa, Borrelia garinii
DLEVLFEDMNG

SEQ ID NO: 211860 - protein, 11 aa, Borrelia garinii
LEVLFEDMNGM

SEQ ID NO: 211861 - protein, 11 aa, Borrelia garinii
EVLFEDMNGME

SEQ ID NO: 211862 - protein, 11 aa, Borrelia garinii
VLFEDMNGMEY

SEQ ID NO: 211863 - protein, 11 aa, Borrelia garinii
LFEDMNGMEYA

SEQ ID NO: 211864 - protein, 11 aa, Borrelia garinii
FEDMNGMEYAY

SEQ ID NO: 211865 - protein, 11 aa, Borrelia garinii
EDMNGMEYAYS

SEQ ID NO: 211866 - protein, 11 aa, Borrelia garinii
DMNGMEYAYSL

SEQ ID NO: 211867 - protein, 11 aa, Borrelia garinii
MNGMEYAYSLG

SEQ ID NO: 211868 - protein, 11 aa, Borrelia garinii
NGMEYAYSLGT

SEQ ID NO: 211869 - protein, 11 aa, Borrelia garinii
GMEYAYSLGTL

SEQ ID NO: 211870 - protein, 11 aa, Borrelia garinii
MEYAYSLGTLK

SEQ ID NO: 211871 - protein, 11 aa, Borrelia garinii
EYAYSLGTLKF

SEQ ID NO: 211872 - protein, 11 aa, Borrelia garinii
YAYSLGTLKFK

SEQ ID NO: 211873 - protein, 11 aa, Borrelia garinii
AYSLGTLKFKG

SEQ ID NO: 211874 - protein, 11 aa, Borrelia garinii
YSLGTLKFKGW

SEQ ID NO: 211875 - protein, 11 aa, Borrelia garinii
SLGTLKFKGWA

SEQ ID NO: 211876 - protein, 11 aa, Borrelia garinii
LGTLKFKGWAD

SEQ ID NO: 211877 - protein, 11 aa, Borrelia garinii
GTLKFKGWADL

SEQ ID NO: 211878 - protein, 11 aa, Borrelia garinii
TLKFKGWADLI

SEQ ID NO: 211879 - protein, 11 aa, Borrelia garinii
LKFKGWADLIW

SEQ ID NO: 211880 - protein, 11 aa, Borrelia garinii
KFKGWADLIWS

SEQ ID NO: 211881 - protein, 11 aa, Borrelia garinii
FKGWADLIWSN

SEQ ID NO: 211882 - protein, 11 aa, Borrelia garinii
KGWADLIWSNP

SEQ ID NO: 211883 - protein, 11 aa, Borrelia garinii
GWADLIWSNPN

SEQ ID NO: 211884 - protein, 11 aa, Borrelia garinii
WADLIWSNPNY

SEQ ID NO: 211885 - protein, 11 aa, Borrelia garinii
ADLIWSNPNYI

SEQ ID NO: 211886 - protein, 11 aa, Borrelia garinii
DLIWSNPNYIP

SEQ ID NO: 211887 - protein, 11 aa, Borrelia garinii
LIWSNPNYIPN

SEQ ID NO: 211888 - protein, 11 aa, Borrelia garinii
IWSNPNYIPNI

SEQ ID NO: 211889 - protein, 11 aa, Borrelia garinii
WSNPNYIPNIS

SEQ ID NO: 211890 - protein, 11 aa, Borrelia garinii
SNPNYIPNISS

SEQ ID NO: 211891 - protein, 11 aa, Borrelia garinii
NPNYIPNISSR

SEQ ID NO: 211892 - protein, 11 aa, Borrelia garinii
PNYIPNISSRI

SEQ ID NO: 211893 - protein, 11 aa, Borrelia garinii
NYIPNISSRII

SEQ ID NO: 211894 - protein, 11 aa, Borrelia garinii
YIPNISSRIIK

SEQ ID NO: 211895 - protein, 11 aa, Borrelia garinii
IPNISSRIIKD

SEQ ID NO: 211896 - protein, 11 aa, Borrelia garinii
PNISSRIIKDD

SEQ ID NO: 211897 - protein, 11 aa, Borrelia garinii
NISSRIIKDDV

SEQ ID NO: 211898 - protein, 11 aa, Borrelia garinii
ISSRIIKDDVP

SEQ ID NO: 211899 - protein, 11 aa, Borrelia garinii
SSRIIKDDVPN

SEQ ID NO: 211900 - protein, 11 aa, Borrelia garinii
SRIIKDDVPNY

SEQ ID NO: 211901 - protein, 11 aa, Borrelia garinii
RIIKDDVPNYP

SEQ ID NO: 211902 - protein, 11 aa, Borrelia garinii
IIKDDVPNYPL

SEQ ID NO: 211903 - protein, 11 aa, Borrelia garinii
IKDDVPNYPLA

SEQ ID NO: 211904 - protein, 11 aa, Borrelia garinii
KDDVPNYPLAS

SEQ ID NO: 211905 - protein, 11 aa, Borrelia garinii
DDVPNYPLASS

SEQ ID NO: 211906 - protein, 11 aa, Borrelia garinii
DVPNYPLASSK

SEQ ID NO: 211907 - protein, 11 aa, Borrelia garinii
VPNYPLASSKM

SEQ ID NO: 211908 - protein, 11 aa, Borrelia garinii
PNYPLASSKMR

SEQ ID NO: 211909 - protein, 11 aa, Borrelia garinii
NYPLASSKMRF

SEQ ID NO: 211910 - protein, 11 aa, Borrelia garinii
YPLASSKMRFK

SEQ ID NO: 211911 - protein, 11 aa, Borrelia garinii
PLASSKMRFKA

SEQ ID NO: 211912 - protein, 11 aa, Borrelia garinii
LASSKMRFKAF

SEQ ID NO: 211913 - protein, 11 aa, Borrelia garinii
ASSKMRFKAFR

SEQ ID NO: 211914 - protein, 11 aa, Borrelia garinii
SSKMRFKAFRV

SEQ ID NO: 211915 - protein, 11 aa, Borrelia garinii
SKMRFKAFRVS

SEQ ID NO: 211916 - protein, 11 aa, Borrelia garinii
KMRFKAFRVSK

SEQ ID NO: 211917 - protein, 11 aa, Borrelia garinii
MRFKAFRVSKS

SEQ ID NO: 211918 - protein, 11 aa, Borrelia garinii
RFKAFRVSKSH

SEQ ID NO: 211919 - protein, 11 aa, Borrelia garinii
FKAFRVSKSHS

SEQ ID NO: 211920 - protein, 11 aa, Borrelia garinii
KAFRVSKSHSS

SEQ ID NO: 211921 - protein, 11 aa, Borrelia garinii
AFRVSKSHSSK

SEQ ID NO: 211922 - protein, 11 aa, Borrelia garinii
FRVSKSHSSKE

SEQ ID NO: 211923 - protein, 11 aa, Borrelia garinii
RVSKSHSSKEQ

SEQ ID NO: 211924 - protein, 11 aa, Borrelia garinii
VSKSHSSKEQN

SEQ ID NO: 211925 - protein, 11 aa, Borrelia garinii
SKSHSSKEQNF

SEQ ID NO: 211926 - protein, 11 aa, Borrelia garinii
KSHSSKEQNFI

SEQ ID NO: 211927 - protein, 11 aa, Borrelia garinii
SHSSKEQNFIF

SEQ ID NO: 211928 - protein, 11 aa, Borrelia garinii
HSSKEQNFIFY

SEQ ID NO: 211929 - protein, 11 aa, Borrelia garinii
SSKEQNFIFYV

SEQ ID NO: 211930 - protein, 11 aa, Borrelia garinii
SKEQNFIFYVK

SEQ ID NO: 211931 - protein, 11 aa, Borrelia garinii
KEQNFIFYVKD

SEQ ID NO: 211932 - protein, 11 aa, Borrelia garinii
EQNFIFYVKDL

SEQ ID NO: 211933 - protein, 11 aa, Borrelia garinii
QNFIFYVKDLR

SEQ ID NO: 211934 - protein, 11 aa, Borrelia garinii
NFIFYVKDLRV

SEQ ID NO: 211935 - protein, 11 aa, Borrelia garinii
FIFYVKDLRVL

SEQ ID NO: 211936 - protein, 11 aa, Borrelia garinii
IFYVKDLRVLY

SEQ ID NO: 211937 - protein, 11 aa, Borrelia garinii
FYVKDLRVLYD

SEQ ID NO: 211938 - protein, 11 aa, Borrelia garinii
YVKDLRVLYDK

SEQ ID NO: 211939 - protein, 11 aa, Borrelia garinii
VKDLRVLYDKL

SEQ ID NO: 211940 - protein, 11 aa, Borrelia garinii
KDLRVLYDKLS

SEQ ID NO: 211941 - protein, 11 aa, Borrelia garinii
DLRVLYDKLSV

SEQ ID NO: 211942 - protein, 11 aa, Borrelia garinii
LRVLYDKLSVS

SEQ ID NO: 211943 - protein, 11 aa, Borrelia garinii
RVLYDKLSVSI

SEQ ID NO: 211944 - protein, 11 aa, Borrelia garinii
VLYDKLSVSID

SEQ ID NO: 211945 - protein, 11 aa, Borrelia garinii
LYDKLSVSIDS

SEQ ID NO: 211946 - protein, 11 aa, Borrelia garinii
YDKLSVSIDSD

SEQ ID NO: 211947 - protein, 11 aa, Borrelia garinii
DKLSVSIDSDI

SEQ ID NO: 211948 - protein, 11 aa, Borrelia garinii
KLSVSIDSDID

SEQ ID NO: 211949 - protein, 11 aa, Borrelia garinii
LSVSIDSDIDS

SEQ ID NO: 211950 - protein, 11 aa, Borrelia garinii
SVSIDSDIDSE

SEQ ID NO: 211951 - protein, 11 aa, Borrelia garinii
VSIDSDIDSES

SEQ ID NO: 211952 - protein, 11 aa, Borrelia garinii
SIDSDIDSESV

SEQ ID NO: 211953 - protein, 11 aa, Borrelia garinii
IDSDIDSESVF

SEQ ID NO: 211954 - protein, 11 aa, Borrelia garinii
DSDIDSESVFK

SEQ ID NO: 211955 - protein, 11 aa, Borrelia garinii
SDIDSESVFKV

SEQ ID NO: 211956 - protein, 11 aa, Borrelia garinii
DIDSESVFKVY

SEQ ID NO: 211957 - protein, 11 aa, Borrelia garinii
IDSESVFKVYE

SEQ ID NO: 211958 - protein, 11 aa, Borrelia garinii
DSESVFKVYET

SEQ ID NO: 211959 - protein, 11 aa, Borrelia garinii
SESVFKVYETS

SEQ ID NO: 211960 - protein, 11 aa, Borrelia garinii
ESVFKVYETSG

SEQ ID NO: 211961 - protein, 11 aa, Borrelia garinii
SVFKVYETSGT

SEQ ID NO: 211962 - protein, 11 aa, Borrelia garinii
VFKVYETSGTE

SEQ ID NO: 211963 - protein, 11 aa, Borrelia garinii
FKVYETSGTES

SEQ ID NO: 211964 - protein, 11 aa, Borrelia garinii
KVYETSGTESL

SEQ ID NO: 211965 - protein, 11 aa, Borrelia garinii
VYETSGTESLR

SEQ ID NO: 211966 - protein, 11 aa, Borrelia garinii
YETSGTESLRK

SEQ ID NO: 211967 - protein, 11 aa, Borrelia garinii
ETSGTESLRKL

SEQ ID NO: 211968 - protein, 11 aa, Borrelia garinii
TSGTESLRKLK

SEQ ID NO: 211969 - protein, 11 aa, Borrelia garinii
SGTESLRKLKA

SEQ ID NO: 211970 - protein, 11 aa, Borrelia garinii
GTESLRKLKAH

SEQ ID NO: 211971 - protein, 11 aa, Borrelia garinii
TESLRKLKAHE

SEQ ID NO: 211972 - protein, 11 aa, Borrelia garinii
ESLRKLKAHET

SEQ ID NO: 211973 - protein, 11 aa, Borrelia garinii
SLRKLKAHETF

SEQ ID NO: 211974 - protein, 11 aa, Borrelia garinii
LRKLKAHETFK

SEQ ID NO: 211975 - protein, 11 aa, Borrelia garinii
RKLKAHETFKR

SEQ ID NO: 211976 - protein, 11 aa, Borrelia garinii
KLKAHETFKRV

SEQ ID NO: 211977 - protein, 11 aa, Borrelia garinii
LKAHETFKRVL

SEQ ID NO: 211978 - protein, 11 aa, Borrelia garinii
KAHETFKRVLK

SEQ ID NO: 211979 - protein, 11 aa, Borrelia garinii
AHETFKRVLKL

SEQ ID NO: 211980 - protein, 11 aa, Borrelia garinii
HETFKRVLKLR

SEQ ID NO: 211981 - protein, 11 aa, Borrelia garinii
ETFKRVLKLRE

SEQ ID NO: 211982 - protein, 11 aa, Borrelia garinii
TFKRVLKLREK

SEQ ID NO: 211983 - protein, 11 aa, Borrelia garinii
FKRVLKLREKI

SEQ ID NO: 211984 - protein, 11 aa, Borrelia garinii
KRVLKLREKIS

SEQ ID NO: 211985 - protein, 11 aa, Borrelia garinii
RVLKLREKISM

SEQ ID NO: 211986 - protein, 11 aa, Borrelia garinii
VLKLREKISMP

SEQ ID NO: 211987 - protein, 11 aa, Borrelia garinii
LKLREKISMPE

SEQ ID NO: 211988 - protein, 11 aa, Borrelia garinii
KLREKISMPEG

SEQ ID NO: 211989 - protein, 11 aa, Borrelia garinii
LREKISMPEGS

SEQ ID NO: 211990 - protein, 11 aa, Borrelia garinii
REKISMPEGSF

SEQ ID NO: 211991 - protein, 11 aa, Borrelia garinii
EKISMPEGSFQ

SEQ ID NO: 211992 - protein, 11 aa, Borrelia garinii
KISMPEGSFQN

SEQ ID NO: 211993 - protein, 11 aa, Borrelia garinii
ISMPEGSFQNF

SEQ ID NO: 211994 - protein, 11 aa, Borrelia garinii
SMPEGSFQNFI

SEQ ID NO: 211995 - protein, 11 aa, Borrelia garinii
MPEGSFQNFIE

SEQ ID NO: 211996 - protein, 11 aa, Borrelia garinii
PEGSFQNFIEK

SEQ ID NO: 211997 - protein, 11 aa, Borrelia garinii
EGSFQNFIEKV

SEQ ID NO: 211998 - protein, 11 aa, Borrelia garinii
GSFQNFIEKVE

SEQ ID NO: 211999 - protein, 11 aa, Borrelia garinii
SFQNFIEKVES

SEQ ID NO: 212000 - protein, 11 aa, Borrelia garinii
FQNFIEKVESE

SEQ ID NO: 212001 - protein, 11 aa, Borrelia garinii
QNFIEKVESEK

SEQ ID NO: 212002 - protein, 11 aa, Borrelia garinii
NFIEKVESEKK

SEQ ID NO: 212003 - protein, 11 aa, Borrelia garinii
FIEKVESEKKP

SEQ ID NO: 212004 - protein, 11 aa, Borrelia garinii
IEKVESEKKPE

SEQ ID NO: 212005 - protein, 11 aa, Borrelia garinii
EKVESEKKPEE

SEQ ID NO: 212006 - protein, 11 aa, Borrelia garinii
KVESEKKPEES

SEQ ID NO: 212007 - protein, 11 aa, Borrelia garinii
VESEKKPEESS

SEQ ID NO: 212008 - protein, 11 aa, Borrelia garinii
ESEKKPEESSL

SEQ ID NO: 212009 - protein, 11 aa, Borrelia garinii
SEKKPEESSLK

SEQ ID NO: 212010 - protein, 11 aa, Borrelia garinii
EKKPEESSLKK

SEQ ID NO: 212011 - protein, 13 aa, Borrelia garinii
MKRKAKSILLFLL

SEQ ID NO: 212012 - protein, 13 aa, Borrelia garinii
KRKAKSILLFLLS

SEQ ID NO: 212013 - protein, 13 aa, Borrelia garinii
RKAKSILLFLLST

SEQ ID NO: 212014 - protein, 13 aa, Borrelia garinii
KAKSILLFLLSTA

SEQ ID NO: 212015 - protein, 13 aa, Borrelia garinii
AKSILLFLLSTAL

SEQ ID NO: 212016 - protein, 13 aa, Borrelia garinii
KSILLFLLSTALF

SEQ ID NO: 212017 - protein, 13 aa, Borrelia garinii
SILLFLLSTALFA

SEQ ID NO: 212018 - protein, 13 aa, Borrelia garinii
ILLFLLSTALFAQ

SEQ ID NO: 212019 - protein, 13 aa, Borrelia garinii
LLFLLSTALFAQE

SEQ ID NO: 212020 - protein, 13 aa, Borrelia garinii
LFLLSTALFAQET

SEQ ID NO: 212021 - protein, 13 aa, Borrelia garinii
FLLSTALFAQETD

SEQ ID NO: 212022 - protein, 13 aa, Borrelia garinii
LLSTALFAQETDG

SEQ ID NO: 212023 - protein, 13 aa, Borrelia garinii
LSTALFAQETDGL

SEQ ID NO: 212024 - protein, 13 aa, Borrelia garinii
STALFAQETDGLP

SEQ ID NO: 212025 - protein, 13 aa, Borrelia garinii
TALFAQETDGLPE

SEQ ID NO: 212026 - protein, 13 aa, Borrelia garinii
ALFAQETDGLPEG

SEQ ID NO: 212027 - protein, 13 aa, Borrelia garinii
LFAQETDGLPEGS

SEQ ID NO: 212028 - protein, 13 aa, Borrelia garinii
FAQETDGLPEGSK

SEQ ID NO: 212029 - protein, 13 aa, Borrelia garinii
AQETDGLPEGSKR

SEQ ID NO: 212030 - protein, 13 aa, Borrelia garinii
QETDGLPEGSKRS

SEQ ID NO: 212031 - protein, 13 aa, Borrelia garinii
ETDGLPEGSKRSE

SEQ ID NO: 212032 - protein, 13 aa, Borrelia garinii
TDGLPEGSKRSEP

SEQ ID NO: 212033 - protein, 13 aa, Borrelia garinii
DGLPEGSKRSEPG

SEQ ID NO: 212034 - protein, 13 aa, Borrelia garinii
GLPEGSKRSEPGE

SEQ ID NO: 212035 - protein, 13 aa, Borrelia garinii
LPEGSKRSEPGEL

SEQ ID NO: 212036 - protein, 13 aa, Borrelia garinii
PEGSKRSEPGELV

SEQ ID NO: 212037 - protein, 13 aa, Borrelia garinii
EGSKRSEPGELVL

SEQ ID NO: 212038 - protein, 13 aa, Borrelia garinii
GSKRSEPGELVLD

SEQ ID NO: 212039 - protein, 13 aa, Borrelia garinii
SKRSEPGELVLDF

SEQ ID NO: 212040 - protein, 13 aa, Borrelia garinii
KRSEPGELVLDFA

SEQ ID NO: 212041 - protein, 13 aa, Borrelia garinii
RSEPGELVLDFAE

SEQ ID NO: 212042 - protein, 13 aa, Borrelia garinii
SEPGELVLDFAEL

SEQ ID NO: 212043 - protein, 13 aa, Borrelia garinii
EPGELVLDFAELA

SEQ ID NO: 212044 - protein, 13 aa, Borrelia garinii
PGELVLDFAELAR

SEQ ID NO: 212045 - protein, 13 aa, Borrelia garinii
GELVLDFAELARD

SEQ ID NO: 212046 - protein, 13 aa, Borrelia garinii
ELVLDFAELARDP

SEQ ID NO: 212047 - protein, 13 aa, Borrelia garinii
LVLDFAELARDPS

SEQ ID NO: 212048 - protein, 13 aa, Borrelia garinii
VLDFAELARDPSS

SEQ ID NO: 212049 - protein, 13 aa, Borrelia garinii
LDFAELARDPSST

SEQ ID NO: 212050 - protein, 13 aa, Borrelia garinii
DFAELARDPSSTK

SEQ ID NO: 212051 - protein, 13 aa, Borrelia garinii
FAELARDPSSTKL

SEQ ID NO: 212052 - protein, 13 aa, Borrelia garinii
AELARDPSSTKLD

SEQ ID NO: 212053 - protein, 13 aa, Borrelia garinii
ELARDPSSTKLDL

SEQ ID NO: 212054 - protein, 13 aa, Borrelia garinii
LARDPSSTKLDLT

SEQ ID NO: 212055 - protein, 13 aa, Borrelia garinii
ARDPSSTKLDLTN

SEQ ID NO: 212056 - protein, 13 aa, Borrelia garinii
RDPSSTKLDLTNY

SEQ ID NO: 212057 - protein, 13 aa, Borrelia garinii
DPSSTKLDLTNYV

SEQ ID NO: 212058 - protein, 13 aa, Borrelia garinii
PSSTKLDLTNYVD

SEQ ID NO: 212059 - protein, 13 aa, Borrelia garinii
SSTKLDLTNYVDY

SEQ ID NO: 212060 - protein, 13 aa, Borrelia garinii
STKLDLTNYVDYV

SEQ ID NO: 212061 - protein, 13 aa, Borrelia garinii
TKLDLTNYVDYVY

SEQ ID NO: 212062 - protein, 13 aa, Borrelia garinii
KLDLTNYVDYVYS

SEQ ID NO: 212063 - protein, 13 aa, Borrelia garinii
LDLTNYVDYVYSG

SEQ ID NO: 212064 - protein, 13 aa, Borrelia garinii
DLTNYVDYVYSGA

SEQ ID NO: 212065 - protein, 13 aa, Borrelia garinii
LTNYVDYVYSGAS

SEQ ID NO: 212066 - protein, 13 aa, Borrelia garinii
TNYVDYVYSGASG

SEQ ID NO: 212067 - protein, 13 aa, Borrelia garinii
NYVDYVYSGASGI

SEQ ID NO: 212068 - protein, 13 aa, Borrelia garinii
YVDYVYSGASGIV

SEQ ID NO: 212069 - protein, 13 aa, Borrelia garinii
VDYVYSGASGIVK

SEQ ID NO: 212070 - protein, 13 aa, Borrelia garinii
DYVYSGASGIVKP

SEQ ID NO: 212071 - protein, 13 aa, Borrelia garinii
YVYSGASGIVKPE

SEQ ID NO: 212072 - protein, 13 aa, Borrelia garinii
VYSGASGIVKPED

SEQ ID NO: 212073 - protein, 13 aa, Borrelia garinii
YSGASGIVKPEDM

SEQ ID NO: 212074 - protein, 13 aa, Borrelia garinii
SGASGIVKPEDMV

SEQ ID NO: 212075 - protein, 13 aa, Borrelia garinii
GASGIVKPEDMVV

SEQ ID NO: 212076 - protein, 13 aa, Borrelia garinii
ASGIVKPEDMVVD

SEQ ID NO: 212077 - protein, 13 aa, Borrelia garinii
SGIVKPEDMVVDL

SEQ ID NO: 212078 - protein, 13 aa, Borrelia garinii
GIVKPEDMVVDLG

SEQ ID NO: 212079 - protein, 13 aa, Borrelia garinii
IVKPEDMVVDLGI

SEQ ID NO: 212080 - protein, 13 aa, Borrelia garinii
VKPEDMVVDLGIN

SEQ ID NO: 212081 - protein, 13 aa, Borrelia garinii
KPEDMVVDLGINN

SEQ ID NO: 212082 - protein, 13 aa, Borrelia garinii
PEDMVVDLGINNW

SEQ ID NO: 212083 - protein, 13 aa, Borrelia garinii
EDMVVDLGINNWS

SEQ ID NO: 212084 - protein, 13 aa, Borrelia garinii
DMVVDLGINNWSV

SEQ ID NO: 212085 - protein, 13 aa, Borrelia garinii
MVVDLGINNWSVL

SEQ ID NO: 212086 - protein, 13 aa, Borrelia garinii
VVDLGINNWSVLL

SEQ ID NO: 212087 - protein, 13 aa, Borrelia garinii
VDLGINNWSVLLT

SEQ ID NO: 212088 - protein, 13 aa, Borrelia garinii
DLGINNWSVLLTP

SEQ ID NO: 212089 - protein, 13 aa, Borrelia garinii
LGINNWSVLLTPS

SEQ ID NO: 212090 - protein, 13 aa, Borrelia garinii
GINNWSVLLTPSA

SEQ ID NO: 212091 - protein, 13 aa, Borrelia garinii
INNWSVLLTPSAR

SEQ ID NO: 212092 - protein, 13 aa, Borrelia garinii
NNWSVLLTPSARL

SEQ ID NO: 212093 - protein, 13 aa, Borrelia garinii
NWSVLLTPSARLQ

SEQ ID NO: 212094 - protein, 13 aa, Borrelia garinii
WSVLLTPSARLQA

SEQ ID NO: 212095 - protein, 13 aa, Borrelia garinii
SVLLTPSARLQAY

SEQ ID NO: 212096 - protein, 13 aa, Borrelia garinii
VLLTPSARLQAYV

SEQ ID NO: 212097 - protein, 13 aa, Borrelia garinii
LLTPSARLQAYVK

SEQ ID NO: 212098 - protein, 13 aa, Borrelia garinii
LTPSARLQAYVKN

SEQ ID NO: 212099 - protein, 13 aa, Borrelia garinii
TPSARLQAYVKNS

SEQ ID NO: 212100 - protein, 13 aa, Borrelia garinii
PSARLQAYVKNSV

SEQ ID NO: 212101 - protein, 13 aa, Borrelia garinii
SARLQAYVKNSVV

SEQ ID NO: 212102 - protein, 13 aa, Borrelia garinii
ARLQAYVKNSVVA

SEQ ID NO: 212103 - protein, 13 aa, Borrelia garinii
RLQAYVKNSVVAP

SEQ ID NO: 212104 - protein, 13 aa, Borrelia garinii
LQAYVKNSVVAPA

SEQ ID NO: 212105 - protein, 13 aa, Borrelia garinii
QAYVKNSVVAPAV

SEQ ID NO: 212106 - protein, 13 aa, Borrelia garinii
AYVKNSVVAPAVV

SEQ ID NO: 212107 - protein, 13 aa, Borrelia garinii
YVKNSVVAPAVVK

SEQ ID NO: 212108 - protein, 13 aa, Borrelia garinii
VKNSVVAPAVVKS

SEQ ID NO: 212109 - protein, 13 aa, Borrelia garinii
KNSVVAPAVVKSE

SEQ ID NO: 212110 - protein, 13 aa, Borrelia garinii
NSVVAPAVVKSES

SEQ ID NO: 212111 - protein, 13 aa, Borrelia garinii
SVVAPAVVKSESK

SEQ ID NO: 212112 - protein, 13 aa, Borrelia garinii
VVAPAVVKSESKR

SEQ ID NO: 212113 - protein, 13 aa, Borrelia garinii
VAPAVVKSESKRY

SEQ ID NO: 212114 - protein, 13 aa, Borrelia garinii
APAVVKSESKRYA

SEQ ID NO: 212115 - protein, 13 aa, Borrelia garinii
PAVVKSESKRYAG

SEQ ID NO: 212116 - protein, 13 aa, Borrelia garinii
AVVKSESKRYAGD

SEQ ID NO: 212117 - protein, 13 aa, Borrelia garinii
VVKSESKRYAGDT

SEQ ID NO: 212118 - protein, 13 aa, Borrelia garinii
VKSESKRYAGDTI

SEQ ID NO: 212119 - protein, 13 aa, Borrelia garinii
KSESKRYAGDTIL

SEQ ID NO: 212120 - protein, 13 aa, Borrelia garinii
SESKRYAGDTILG

SEQ ID NO: 212121 - protein, 13 aa, Borrelia garinii
ESKRYAGDTILGV

SEQ ID NO: 212122 - protein, 13 aa, Borrelia garinii
SKRYAGDTILGVR

SEQ ID NO: 212123 - protein, 13 aa, Borrelia garinii
KRYAGDTILGVRV

SEQ ID NO: 212124 - protein, 13 aa, Borrelia garinii
RYAGDTILGVRVL

SEQ ID NO: 212125 - protein, 13 aa, Borrelia garinii
YAGDTILGVRVLF

SEQ ID NO: 212126 - protein, 13 aa, Borrelia garinii
AGDTILGVRVLFP

SEQ ID NO: 212127 - protein, 13 aa, Borrelia garinii
GDTILGVRVLFPS

SEQ ID NO: 212128 - protein, 13 aa, Borrelia garinii
DTILGVRVLFPSY

SEQ ID NO: 212129 - protein, 13 aa, Borrelia garinii
TILGVRVLFPSYS

SEQ ID NO: 212130 - protein, 13 aa, Borrelia garinii
ILGVRVLFPSYSQ

SEQ ID NO: 212131 - protein, 13 aa, Borrelia garinii
LGVRVLFPSYSQS

SEQ ID NO: 212132 - protein, 13 aa, Borrelia garinii
GVRVLFPSYSQSS

SEQ ID NO: 212133 - protein, 13 aa, Borrelia garinii
VRVLFPSYSQSSA

SEQ ID NO: 212134 - protein, 13 aa, Borrelia garinii
RVLFPSYSQSSAM

SEQ ID NO: 212135 - protein, 13 aa, Borrelia garinii
VLFPSYSQSSAMI

SEQ ID NO: 212136 - protein, 13 aa, Borrelia garinii
LFPSYSQSSAMIM

SEQ ID NO: 212137 - protein, 13 aa, Borrelia garinii
FPSYSQSSAMIMP

SEQ ID NO: 212138 - protein, 13 aa, Borrelia garinii
PSYSQSSAMIMPP

SEQ ID NO: 212139 - protein, 13 aa, Borrelia garinii
SYSQSSAMIMPPF

SEQ ID NO: 212140 - protein, 13 aa, Borrelia garinii
YSQSSAMIMPPFK

SEQ ID NO: 212141 - protein, 13 aa, Borrelia garinii
SQSSAMIMPPFKI

SEQ ID NO: 212142 - protein, 13 aa, Borrelia garinii
QSSAMIMPPFKIP

SEQ ID NO: 212143 - protein, 13 aa, Borrelia garinii
SSAMIMPPFKIPF

SEQ ID NO: 212144 - protein, 13 aa, Borrelia garinii
SAMIMPPFKIPFY

SEQ ID NO: 212145 - protein, 13 aa, Borrelia garinii
AMIMPPFKIPFYS

SEQ ID NO: 212146 - protein, 13 aa, Borrelia garinii
MIMPPFKIPFYSG

SEQ ID NO: 212147 - protein, 13 aa, Borrelia garinii
IMPPFKIPFYSGE

SEQ ID NO: 212148 - protein, 13 aa, Borrelia garinii
MPPFKIPFYSGEN

SEQ ID NO: 212149 - protein, 13 aa, Borrelia garinii
PPFKIPFYSGENG

SEQ ID NO: 212150 - protein, 13 aa, Borrelia garinii
PFKIPFYSGENGN

SEQ ID NO: 212151 - protein, 13 aa, Borrelia garinii
FKIPFYSGENGNQ

SEQ ID NO: 212152 - protein, 13 aa, Borrelia garinii
KIPFYSGENGNQF

SEQ ID NO: 212153 - protein, 13 aa, Borrelia garinii
IPFYSGENGNQFL

SEQ ID NO: 212154 - protein, 13 aa, Borrelia garinii
PFYSGENGNQFLG

SEQ ID NO: 212155 - protein, 13 aa, Borrelia garinii
FYSGENGNQFLGK

SEQ ID NO: 212156 - protein, 13 aa, Borrelia garinii
YSGENGNQFLGKG

SEQ ID NO: 212157 - protein, 13 aa, Borrelia garinii
SGENGNQFLGKGL

SEQ ID NO: 212158 - protein, 13 aa, Borrelia garinii
GENGNQFLGKGLI

SEQ ID NO: 212159 - protein, 13 aa, Borrelia garinii
ENGNQFLGKGLIN

SEQ ID NO: 212160 - protein, 13 aa, Borrelia garinii
NGNQFLGKGLINN

SEQ ID NO: 212161 - protein, 13 aa, Borrelia garinii
GNQFLGKGLINNI

SEQ ID NO: 212162 - protein, 13 aa, Borrelia garinii
NQFLGKGLINNIK

SEQ ID NO: 212163 - protein, 13 aa, Borrelia garinii
QFLGKGLINNIKT

SEQ ID NO: 212164 - protein, 13 aa, Borrelia garinii
FLGKGLINNIKTM

SEQ ID NO: 212165 - protein, 13 aa, Borrelia garinii
LGKGLINNIKTMK

SEQ ID NO: 212166 - protein, 13 aa, Borrelia garinii
GKGLINNIKTMKE

SEQ ID NO: 212167 - protein, 13 aa, Borrelia garinii
KGLINNIKTMKEI

SEQ ID NO: 212168 - protein, 13 aa, Borrelia garinii
GLINNIKTMKEIK

SEQ ID NO: 212169 - protein, 13 aa, Borrelia garinii
LINNIKTMKEIKV

SEQ ID NO: 212170 - protein, 13 aa, Borrelia garinii
INNIKTMKEIKVS

SEQ ID NO: 212171 - protein, 13 aa, Borrelia garinii
NNIKTMKEIKVSV

SEQ ID NO: 212172 - protein, 13 aa, Borrelia garinii
NIKTMKEIKVSVY

SEQ ID NO: 212173 - protein, 13 aa, Borrelia garinii
IKTMKEIKVSVYS

SEQ ID NO: 212174 - protein, 13 aa, Borrelia garinii
KTMKEIKVSVYSL

SEQ ID NO: 212175 - protein, 13 aa, Borrelia garinii
TMKEIKVSVYSLG

SEQ ID NO: 212176 - protein, 13 aa, Borrelia garinii
MKEIKVSVYSLGY

SEQ ID NO: 212177 - protein, 13 aa, Borrelia garinii
KEIKVSVYSLGYE

SEQ ID NO: 212178 - protein, 13 aa, Borrelia garinii
EIKVSVYSLGYEI

SEQ ID NO: 212179 - protein, 13 aa, Borrelia garinii
IKVSVYSLGYEID

SEQ ID NO: 212180 - protein, 13 aa, Borrelia garinii
KVSVYSLGYEIDL

SEQ ID NO: 212181 - protein, 13 aa, Borrelia garinii
VSVYSLGYEIDLE

SEQ ID NO: 212182 - protein, 13 aa, Borrelia garinii
SVYSLGYEIDLEV

SEQ ID NO: 212183 - protein, 13 aa, Borrelia garinii
VYSLGYEIDLEVL

SEQ ID NO: 212184 - protein, 13 aa, Borrelia garinii
YSLGYEIDLEVLF

SEQ ID NO: 212185 - protein, 13 aa, Borrelia garinii
SLGYEIDLEVLFE

SEQ ID NO: 212186 - protein, 13 aa, Borrelia garinii
LGYEIDLEVLFED

SEQ ID NO: 212187 - protein, 13 aa, Borrelia garinii
GYEIDLEVLFEDM

SEQ ID NO: 212188 - protein, 13 aa, Borrelia garinii
YEIDLEVLFEDMN

SEQ ID NO: 212189 - protein, 13 aa, Borrelia garinii
EIDLEVLFEDMNG

SEQ ID NO: 212190 - protein, 13 aa, Borrelia garinii
IDLEVLFEDMNGM

SEQ ID NO: 212191 - protein, 13 aa, Borrelia garinii
DLEVLFEDMNGME

SEQ ID NO: 212192 - protein, 13 aa, Borrelia garinii
LEVLFEDMNGMEY

SEQ ID NO: 212193 - protein, 13 aa, Borrelia garinii
EVLFEDMNGMEYA

SEQ ID NO: 212194 - protein, 13 aa, Borrelia garinii
VLFEDMNGMEYAY

SEQ ID NO: 212195 - protein, 13 aa, Borrelia garinii
LFEDMNGMEYAYS

SEQ ID NO: 212196 - protein, 13 aa, Borrelia garinii
FEDMNGMEYAYSL

SEQ ID NO: 212197 - protein, 13 aa, Borrelia garinii
EDMNGMEYAYSLG

SEQ ID NO: 212198 - protein, 13 aa, Borrelia garinii
DMNGMEYAYSLGT

SEQ ID NO: 212199 - protein, 13 aa, Borrelia garinii
MNGMEYAYSLGTL

SEQ ID NO: 212200 - protein, 13 aa, Borrelia garinii
NGMEYAYSLGTLK

SEQ ID NO: 212201 - protein, 13 aa, Borrelia garinii
GMEYAYSLGTLKF

SEQ ID NO: 212202 - protein, 13 aa, Borrelia garinii
MEYAYSLGTLKFK

SEQ ID NO: 212203 - protein, 13 aa, Borrelia garinii
EYAYSLGTLKFKG

SEQ ID NO: 212204 - protein, 13 aa, Borrelia garinii
YAYSLGTLKFKGW

SEQ ID NO: 212205 - protein, 13 aa, Borrelia garinii
AYSLGTLKFKGWA

SEQ ID NO: 212206 - protein, 13 aa, Borrelia garinii
YSLGTLKFKGWAD

SEQ ID NO: 212207 - protein, 13 aa, Borrelia garinii
SLGTLKFKGWADL

SEQ ID NO: 212208 - protein, 13 aa, Borrelia garinii
LGTLKFKGWADLI

SEQ ID NO: 212209 - protein, 13 aa, Borrelia garinii
GTLKFKGWADLIW

SEQ ID NO: 212210 - protein, 13 aa, Borrelia garinii
TLKFKGWADLIWS

SEQ ID NO: 212211 - protein, 13 aa, Borrelia garinii
LKFKGWADLIWSN

SEQ ID NO: 212212 - protein, 13 aa, Borrelia garinii
KFKGWADLIWSNP

SEQ ID NO: 212213 - protein, 13 aa, Borrelia garinii
FKGWADLIWSNPN

SEQ ID NO: 212214 - protein, 13 aa, Borrelia garinii
KGWADLIWSNPNY

SEQ ID NO: 212215 - protein, 13 aa, Borrelia garinii
GWADLIWSNPNYI

SEQ ID NO: 212216 - protein, 13 aa, Borrelia garinii
WADLIWSNPNYIP

SEQ ID NO: 212217 - protein, 13 aa, Borrelia garinii
ADLIWSNPNYIPN

SEQ ID NO: 212218 - protein, 13 aa, Borrelia garinii
DLIWSNPNYIPNI

SEQ ID NO: 212219 - protein, 13 aa, Borrelia garinii
LIWSNPNYIPNIS

SEQ ID NO: 212220 - protein, 13 aa, Borrelia garinii
IWSNPNYIPNISS

SEQ ID NO: 212221 - protein, 13 aa, Borrelia garinii
WSNPNYIPNISSR

SEQ ID NO: 212222 - protein, 13 aa, Borrelia garinii
SNPNYIPNISSRI

SEQ ID NO: 212223 - protein, 13 aa, Borrelia garinii
NPNYIPNISSRII

SEQ ID NO: 212224 - protein, 13 aa, Borrelia garinii
PNYIPNISSRIIK

SEQ ID NO: 212225 - protein, 13 aa, Borrelia garinii
NYIPNISSRIIKD

SEQ ID NO: 212226 - protein, 13 aa, Borrelia garinii
YIPNISSRIIKDD

SEQ ID NO: 212227 - protein, 13 aa, Borrelia garinii
IPNISSRIIKDDV

SEQ ID NO: 212228 - protein, 13 aa, Borrelia garinii
PNISSRIIKDDVP

SEQ ID NO: 212229 - protein, 13 aa, Borrelia garinii
NISSRIIKDDVPN

SEQ ID NO: 212230 - protein, 13 aa, Borrelia garinii
ISSRIIKDDVPNY

SEQ ID NO: 212231 - protein, 13 aa, Borrelia garinii
SSRIIKDDVPNYP

SEQ ID NO: 212232 - protein, 13 aa, Borrelia garinii
SRIIKDDVPNYPL

SEQ ID NO: 212233 - protein, 13 aa, Borrelia garinii
RIIKDDVPNYPLA

SEQ ID NO: 212234 - protein, 13 aa, Borrelia garinii
IIKDDVPNYPLAS

SEQ ID NO: 212235 - protein, 13 aa, Borrelia garinii
IKDDVPNYPLASS

SEQ ID NO: 212236 - protein, 13 aa, Borrelia garinii
KDDVPNYPLASSK

SEQ ID NO: 212237 - protein, 13 aa, Borrelia garinii
DDVPNYPLASSKM

SEQ ID NO: 212238 - protein, 13 aa, Borrelia garinii
DVPNYPLASSKMR

SEQ ID NO: 212239 - protein, 13 aa, Borrelia garinii
VPNYPLASSKMRF

SEQ ID NO: 212240 - protein, 13 aa, Borrelia garinii
PNYPLASSKMRFK

SEQ ID NO: 212241 - protein, 13 aa, Borrelia garinii
NYPLASSKMRFKA

SEQ ID NO: 212242 - protein, 13 aa, Borrelia garinii
YPLASSKMRFKAF

SEQ ID NO: 212243 - protein, 13 aa, Borrelia garinii
PLASSKMRFKAFR

SEQ ID NO: 212244 - protein, 13 aa, Borrelia garinii
LASSKMRFKAFRV

SEQ ID NO: 212245 - protein, 13 aa, Borrelia garinii
ASSKMRFKAFRVS

SEQ ID NO: 212246 - protein, 13 aa, Borrelia garinii
SSKMRFKAFRVSK

SEQ ID NO: 212247 - protein, 13 aa, Borrelia garinii
SKMRFKAFRVSKS

SEQ ID NO: 212248 - protein, 13 aa, Borrelia garinii
KMRFKAFRVSKSH

SEQ ID NO: 212249 - protein, 13 aa, Borrelia garinii
MRFKAFRVSKSHS

SEQ ID NO: 212250 - protein, 13 aa, Borrelia garinii
RFKAFRVSKSHSS

SEQ ID NO: 212251 - protein, 13 aa, Borrelia garinii
FKAFRVSKSHSSK

SEQ ID NO: 212252 - protein, 13 aa, Borrelia garinii
KAFRVSKSHSSKE

SEQ ID NO: 212253 - protein, 13 aa, Borrelia garinii
AFRVSKSHSSKEQ

SEQ ID NO: 212254 - protein, 13 aa, Borrelia garinii
FRVSKSHSSKEQN

SEQ ID NO: 212255 - protein, 13 aa, Borrelia garinii
RVSKSHSSKEQNF

SEQ ID NO: 212256 - protein, 13 aa, Borrelia garinii
VSKSHSSKEQNFI

SEQ ID NO: 212257 - protein, 13 aa, Borrelia garinii
SKSHSSKEQNFIF

SEQ ID NO: 212258 - protein, 13 aa, Borrelia garinii
KSHSSKEQNFIFY

SEQ ID NO: 212259 - protein, 13 aa, Borrelia garinii
SHSSKEQNFIFYV

SEQ ID NO: 212260 - protein, 13 aa, Borrelia garinii
HSSKEQNFIFYVK

SEQ ID NO: 212261 - protein, 13 aa, Borrelia garinii
SSKEQNFIFYVKD

SEQ ID NO: 212262 - protein, 13 aa, Borrelia garinii
SKEQNFIFYVKDL

SEQ ID NO: 212263 - protein, 13 aa, Borrelia garinii
KEQNFIFYVKDLR

SEQ ID NO: 212264 - protein, 13 aa, Borrelia garinii
EQNFIFYVKDLRV

SEQ ID NO: 212265 - protein, 13 aa, Borrelia garinii
QNFIFYVKDLRVL

SEQ ID NO: 212266 - protein, 13 aa, Borrelia garinii
NFIFYVKDLRVLY

SEQ ID NO: 212267 - protein, 13 aa, Borrelia garinii
FIFYVKDLRVLYD

SEQ ID NO: 212268 - protein, 13 aa, Borrelia garinii
IFYVKDLRVLYDK

SEQ ID NO: 212269 - protein, 13 aa, Borrelia garinii
FYVKDLRVLYDKL

SEQ ID NO: 212270 - protein, 13 aa, Borrelia garinii
YVKDLRVLYDKLS

SEQ ID NO: 212271 - protein, 13 aa, Borrelia garinii
VKDLRVLYDKLSV

SEQ ID NO: 212272 - protein, 13 aa, Borrelia garinii
KDLRVLYDKLSVS

SEQ ID NO: 212273 - protein, 13 aa, Borrelia garinii
DLRVLYDKLSVSI

SEQ ID NO: 212274 - protein, 13 aa, Borrelia garinii
LRVLYDKLSVSID

SEQ ID NO: 212275 - protein, 13 aa, Borrelia garinii
RVLYDKLSVSIDS

SEQ ID NO: 212276 - protein, 13 aa, Borrelia garinii
VLYDKLSVSIDSD

SEQ ID NO: 212277 - protein, 13 aa, Borrelia garinii
LYDKLSVSIDSDI

SEQ ID NO: 212278 - protein, 13 aa, Borrelia garinii
YDKLSVSIDSDID

SEQ ID NO: 212279 - protein, 13 aa, Borrelia garinii
DKLSVSIDSDIDS

SEQ ID NO: 212280 - protein, 13 aa, Borrelia garinii
KLSVSIDSDIDSE

SEQ ID NO: 212281 - protein, 13 aa, Borrelia garinii
LSVSIDSDIDSES

SEQ ID NO: 212282 - protein, 13 aa, Borrelia garinii
SVSIDSDIDSESV

SEQ ID NO: 212283 - protein, 13 aa, Borrelia garinii
VSIDSDIDSESVF

SEQ ID NO: 212284 - protein, 13 aa, Borrelia garinii
SIDSDIDSESVFK

SEQ ID NO: 212285 - protein, 13 aa, Borrelia garinii
IDSDIDSESVFKV

SEQ ID NO: 212286 - protein, 13 aa, Borrelia garinii
DSDIDSESVFKVY

SEQ ID NO: 212287 - protein, 13 aa, Borrelia garinii
SDIDSESVFKVYE

SEQ ID NO: 212288 - protein, 13 aa, Borrelia garinii
DIDSESVFKVYET

SEQ ID NO: 212289 - protein, 13 aa, Borrelia garinii
IDSESVFKVYETS

SEQ ID NO: 212290 - protein, 13 aa, Borrelia garinii
DSESVFKVYETSG

SEQ ID NO: 212291 - protein, 13 aa, Borrelia garinii
SESVFKVYETSGT

SEQ ID NO: 212292 - protein, 13 aa, Borrelia garinii
ESVFKVYETSGTE

SEQ ID NO: 212293 - protein, 13 aa, Borrelia garinii
SVFKVYETSGTES

SEQ ID NO: 212294 - protein, 13 aa, Borrelia garinii
VFKVYETSGTESL

SEQ ID NO: 212295 - protein, 13 aa, Borrelia garinii
FKVYETSGTESLR

SEQ ID NO: 212296 - protein, 13 aa, Borrelia garinii
KVYETSGTESLRK

SEQ ID NO: 212297 - protein, 13 aa, Borrelia garinii
VYETSGTESLRKL

SEQ ID NO: 212298 - protein, 13 aa, Borrelia garinii
YETSGTESLRKLK

SEQ ID NO: 212299 - protein, 13 aa, Borrelia garinii
ETSGTESLRKLKA

SEQ ID NO: 212300 - protein, 13 aa, Borrelia garinii
TSGTESLRKLKAH

SEQ ID NO: 212301 - protein, 13 aa, Borrelia garinii
SGTESLRKLKAHE

SEQ ID NO: 212302 - protein, 13 aa, Borrelia garinii
GTESLRKLKAHET

SEQ ID NO: 212303 - protein, 13 aa, Borrelia garinii
TESLRKLKAHETF

SEQ ID NO: 212304 - protein, 13 aa, Borrelia garinii
ESLRKLKAHETFK

SEQ ID NO: 212305 - protein, 13 aa, Borrelia garinii
SLRKLKAHETFKR

SEQ ID NO: 212306 - protein, 13 aa, Borrelia garinii
LRKLKAHETFKRV

SEQ ID NO: 212307 - protein, 13 aa, Borrelia garinii
RKLKAHETFKRVL

SEQ ID NO: 212308 - protein, 13 aa, Borrelia garinii
KLKAHETFKRVLK

SEQ ID NO: 212309 - protein, 13 aa, Borrelia garinii
LKAHETFKRVLKL

SEQ ID NO: 212310 - protein, 13 aa, Borrelia garinii
KAHETFKRVLKLR

SEQ ID NO: 212311 - protein, 13 aa, Borrelia garinii
AHETFKRVLKLRE

SEQ ID NO: 212312 - protein, 13 aa, Borrelia garinii
HETFKRVLKLREK

SEQ ID NO: 212313 - protein, 13 aa, Borrelia garinii
ETFKRVLKLREKI

SEQ ID NO: 212314 - protein, 13 aa, Borrelia garinii
TFKRVLKLREKIS

SEQ ID NO: 212315 - protein, 13 aa, Borrelia garinii
FKRVLKLREKISM

SEQ ID NO: 212316 - protein, 13 aa, Borrelia garinii
KRVLKLREKISMP

SEQ ID NO: 212317 - protein, 13 aa, Borrelia garinii
RVLKLREKISMPE

SEQ ID NO: 212318 - protein, 13 aa, Borrelia garinii
VLKLREKISMPEG

SEQ ID NO: 212319 - protein, 13 aa, Borrelia garinii
LKLREKISMPEGS

SEQ ID NO: 212320 - protein, 13 aa, Borrelia garinii
KLREKISMPEGSF

SEQ ID NO: 212321 - protein, 13 aa, Borrelia garinii
LREKISMPEGSFQ

SEQ ID NO: 212322 - protein, 13 aa, Borrelia garinii
REKISMPEGSFQN

SEQ ID NO: 212323 - protein, 13 aa, Borrelia garinii
EKISMPEGSFQNF

SEQ ID NO: 212324 - protein, 13 aa, Borrelia garinii
KISMPEGSFQNFI

SEQ ID NO: 212325 - protein, 13 aa, Borrelia garinii
ISMPEGSFQNFIE

SEQ ID NO: 212326 - protein, 13 aa, Borrelia garinii
SMPEGSFQNFIEK

SEQ ID NO: 212327 - protein, 13 aa, Borrelia garinii
MPEGSFQNFIEKV

SEQ ID NO: 212328 - protein, 13 aa, Borrelia garinii
PEGSFQNFIEKVE

SEQ ID NO: 212329 - protein, 13 aa, Borrelia garinii
EGSFQNFIEKVES

SEQ ID NO: 212330 - protein, 13 aa, Borrelia garinii
GSFQNFIEKVESE

SEQ ID NO: 212331 - protein, 13 aa, Borrelia garinii
SFQNFIEKVESEK

SEQ ID NO: 212332 - protein, 13 aa, Borrelia garinii
FQNFIEKVESEKK

SEQ ID NO: 212333 - protein, 13 aa, Borrelia garinii
QNFIEKVESEKKP

SEQ ID NO: 212334 - protein, 13 aa, Borrelia garinii
NFIEKVESEKKPE

SEQ ID NO: 212335 - protein, 13 aa, Borrelia garinii
FIEKVESEKKPEE

SEQ ID NO: 212336 - protein, 13 aa, Borrelia garinii
IEKVESEKKPEES

SEQ ID NO: 212337 - protein, 13 aa, Borrelia garinii
EKVESEKKPEESS

SEQ ID NO: 212338 - protein, 13 aa, Borrelia garinii
KVESEKKPEESSL

SEQ ID NO: 212339 - protein, 13 aa, Borrelia garinii
VESEKKPEESSLK

SEQ ID NO: 212340 - protein, 13 aa, Borrelia garinii
ESEKKPEESSLKK

SEQ ID NO: 212341 - protein, 14 aa, Borrelia garinii
MKRKAKSILLFLLS

SEQ ID NO: 212342 - protein, 14 aa, Borrelia garinii
KRKAKSILLFLLST

SEQ ID NO: 212343 - protein, 14 aa, Borrelia garinii
RKAKSILLFLLSTA

SEQ ID NO: 212344 - protein, 14 aa, Borrelia garinii
KAKSILLFLLSTAL

SEQ ID NO: 212345 - protein, 14 aa, Borrelia garinii
AKSILLFLLSTALF

SEQ ID NO: 212346 - protein, 14 aa, Borrelia garinii
KSILLFLLSTALFA

SEQ ID NO: 212347 - protein, 14 aa, Borrelia garinii
SILLFLLSTALFAQ

SEQ ID NO: 212348 - protein, 14 aa, Borrelia garinii
ILLFLLSTALFAQE

SEQ ID NO: 212349 - protein, 14 aa, Borrelia garinii
LLFLLSTALFAQET

SEQ ID NO: 212350 - protein, 14 aa, Borrelia garinii
LFLLSTALFAQETD

SEQ ID NO: 212351 - protein, 14 aa, Borrelia garinii
FLLSTALFAQETDG

SEQ ID NO: 212352 - protein, 14 aa, Borrelia garinii
LLSTALFAQETDGL

SEQ ID NO: 212353 - protein, 14 aa, Borrelia garinii
LSTALFAQETDGLP

SEQ ID NO: 212354 - protein, 14 aa, Borrelia garinii
STALFAQETDGLPE

SEQ ID NO: 212355 - protein, 14 aa, Borrelia garinii
TALFAQETDGLPEG

SEQ ID NO: 212356 - protein, 14 aa, Borrelia garinii
ALFAQETDGLPEGS

SEQ ID NO: 212357 - protein, 14 aa, Borrelia garinii
LFAQETDGLPEGSK

SEQ ID NO: 212358 - protein, 14 aa, Borrelia garinii
FAQETDGLPEGSKR

SEQ ID NO: 212359 - protein, 14 aa, Borrelia garinii
AQETDGLPEGSKRS

SEQ ID NO: 212360 - protein, 14 aa, Borrelia garinii
QETDGLPEGSKRSE

SEQ ID NO: 212361 - protein, 14 aa, Borrelia garinii
ETDGLPEGSKRSEP

SEQ ID NO: 212362 - protein, 14 aa, Borrelia garinii
TDGLPEGSKRSEPG

SEQ ID NO: 212363 - protein, 14 aa, Borrelia garinii
DGLPEGSKRSEPGE

SEQ ID NO: 212364 - protein, 14 aa, Borrelia garinii
GLPEGSKRSEPGEL

SEQ ID NO: 212365 - protein, 14 aa, Borrelia garinii
LPEGSKRSEPGELV

SEQ ID NO: 212366 - protein, 14 aa, Borrelia garinii
PEGSKRSEPGELVL

SEQ ID NO: 212367 - protein, 14 aa, Borrelia garinii
EGSKRSEPGELVLD

SEQ ID NO: 212368 - protein, 14 aa, Borrelia garinii
GSKRSEPGELVLDF

SEQ ID NO: 212369 - protein, 14 aa, Borrelia garinii
SKRSEPGELVLDFA

SEQ ID NO: 212370 - protein, 14 aa, Borrelia garinii
KRSEPGELVLDFAE

SEQ ID NO: 212371 - protein, 14 aa, Borrelia garinii
RSEPGELVLDFAEL

SEQ ID NO: 212372 - protein, 14 aa, Borrelia garinii
SEPGELVLDFAELA

SEQ ID NO: 212373 - protein, 14 aa, Borrelia garinii
EPGELVLDFAELAR

SEQ ID NO: 212374 - protein, 14 aa, Borrelia garinii
PGELVLDFAELARD

SEQ ID NO: 212375 - protein, 14 aa, Borrelia garinii
GELVLDFAELARDP

SEQ ID NO: 212376 - protein, 14 aa, Borrelia garinii
ELVLDFAELARDPS

SEQ ID NO: 212377 - protein, 14 aa, Borrelia garinii
LVLDFAELARDPSS

SEQ ID NO: 212378 - protein, 14 aa, Borrelia garinii
VLDFAELARDPSST

SEQ ID NO: 212379 - protein, 14 aa, Borrelia garinii
LDFAELARDPSSTK

SEQ ID NO: 212380 - protein, 14 aa, Borrelia garinii
DFAELARDPSSTKL

SEQ ID NO: 212381 - protein, 14 aa, Borrelia garinii
FAELARDPSSTKLD

SEQ ID NO: 212382 - protein, 14 aa, Borrelia garinii
AELARDPSSTKLDL

SEQ ID NO: 212383 - protein, 14 aa, Borrelia garinii
ELARDPSSTKLDLT

SEQ ID NO: 212384 - protein, 14 aa, Borrelia garinii
LARDPSSTKLDLTN

SEQ ID NO: 212385 - protein, 14 aa, Borrelia garinii
ARDPSSTKLDLTNY

SEQ ID NO: 212386 - protein, 14 aa, Borrelia garinii
RDPSSTKLDLTNYV

SEQ ID NO: 212387 - protein, 14 aa, Borrelia garinii
DPSSTKLDLTNYVD

SEQ ID NO: 212388 - protein, 14 aa, Borrelia garinii
PSSTKLDLTNYVDY

SEQ ID NO: 212389 - protein, 14 aa, Borrelia garinii
SSTKLDLTNYVDYV

SEQ ID NO: 212390 - protein, 14 aa, Borrelia garinii
STKLDLTNYVDYVY

SEQ ID NO: 212391 - protein, 14 aa, Borrelia garinii
TKLDLTNYVDYVYS

SEQ ID NO: 212392 - protein, 14 aa, Borrelia garinii
KLDLTNYVDYVYSG

SEQ ID NO: 212393 - protein, 14 aa, Borrelia garinii
LDLTNYVDYVYSGA

SEQ ID NO: 212394 - protein, 14 aa, Borrelia garinii
DLTNYVDYVYSGAS

SEQ ID NO: 212395 - protein, 14 aa, Borrelia garinii
LTNYVDYVYSGASG

SEQ ID NO: 212396 - protein, 14 aa, Borrelia garinii
TNYVDYVYSGASGI

SEQ ID NO: 212397 - protein, 14 aa, Borrelia garinii
NYVDYVYSGASGIV

SEQ ID NO: 212398 - protein, 14 aa, Borrelia garinii
YVDYVYSGASGIVK

SEQ ID NO: 212399 - protein, 14 aa, Borrelia garinii
VDYVYSGASGIVKP

SEQ ID NO: 212400 - protein, 14 aa, Borrelia garinii
DYVYSGASGIVKPE

SEQ ID NO: 212401 - protein, 14 aa, Borrelia garinii
YVYSGASGIVKPED

SEQ ID NO: 212402 - protein, 14 aa, Borrelia garinii
VYSGASGIVKPEDM

SEQ ID NO: 212403 - protein, 14 aa, Borrelia garinii
YSGASGIVKPEDMV

SEQ ID NO: 212404 - protein, 14 aa, Borrelia garinii
SGASGIVKPEDMVV

SEQ ID NO: 212405 - protein, 14 aa, Borrelia garinii
GASGIVKPEDMVVD

SEQ ID NO: 212406 - protein, 14 aa, Borrelia garinii
ASGIVKPEDMVVDL

SEQ ID NO: 212407 - protein, 14 aa, Borrelia garinii
SGIVKPEDMVVDLG

SEQ ID NO: 212408 - protein, 14 aa, Borrelia garinii
GIVKPEDMVVDLGI

SEQ ID NO: 212409 - protein, 14 aa, Borrelia garinii
IVKPEDMVVDLGIN

SEQ ID NO: 212410 - protein, 14 aa, Borrelia garinii
VKPEDMVVDLGINN

SEQ ID NO: 212411 - protein, 14 aa, Borrelia garinii
KPEDMVVDLGINNW

SEQ ID NO: 212412 - protein, 14 aa, Borrelia garinii
PEDMVVDLGINNWS

SEQ ID NO: 212413 - protein, 14 aa, Borrelia garinii
EDMVVDLGINNWSV

SEQ ID NO: 212414 - protein, 14 aa, Borrelia garinii
DMVVDLGINNWSVL

SEQ ID NO: 212415 - protein, 14 aa, Borrelia garinii
MVVDLGINNWSVLL

SEQ ID NO: 212416 - protein, 14 aa, Borrelia garinii
VVDLGINNWSVLLT

SEQ ID NO: 212417 - protein, 14 aa, Borrelia garinii
VDLGINNWSVLLTP

SEQ ID NO: 212418 - protein, 14 aa, Borrelia garinii
DLGINNWSVLLTPS

SEQ ID NO: 212419 - protein, 14 aa, Borrelia garinii
LGINNWSVLLTPSA

SEQ ID NO: 212420 - protein, 14 aa, Borrelia garinii
GINNWSVLLTPSAR

SEQ ID NO: 212421 - protein, 14 aa, Borrelia garinii
INNWSVLLTPSARL

SEQ ID NO: 212422 - protein, 14 aa, Borrelia garinii
NNWSVLLTPSARLQ

SEQ ID NO: 212423 - protein, 14 aa, Borrelia garinii
NWSVLLTPSARLQA

SEQ ID NO: 212424 - protein, 14 aa, Borrelia garinii
WSVLLTPSARLQAY

SEQ ID NO: 212425 - protein, 14 aa, Borrelia garinii
SVLLTPSARLQAYV

SEQ ID NO: 212426 - protein, 14 aa, Borrelia garinii
VLLTPSARLQAYVK

SEQ ID NO: 212427 - protein, 14 aa, Borrelia garinii
LLTPSARLQAYVKN

SEQ ID NO: 212428 - protein, 14 aa, Borrelia garinii
LTPSARLQAYVKNS

SEQ ID NO: 212429 - protein, 14 aa, Borrelia garinii
TPSARLQAYVKNSV

SEQ ID NO: 212430 - protein, 14 aa, Borrelia garinii
PSARLQAYVKNSVV

SEQ ID NO: 212431 - protein, 14 aa, Borrelia garinii
SARLQAYVKNSVVA

SEQ ID NO: 212432 - protein, 14 aa, Borrelia garinii
ARLQAYVKNSVVAP

SEQ ID NO: 212433 - protein, 14 aa, Borrelia garinii
RLQAYVKNSVVAPA

SEQ ID NO: 212434 - protein, 14 aa, Borrelia garinii
LQAYVKNSVVAPAV

SEQ ID NO: 212435 - protein, 14 aa, Borrelia garinii
QAYVKNSVVAPAVV

SEQ ID NO: 212436 - protein, 14 aa, Borrelia garinii
AYVKNSVVAPAVVK

SEQ ID NO: 212437 - protein, 14 aa, Borrelia garinii
YVKNSVVAPAVVKS

SEQ ID NO: 212438 - protein, 14 aa, Borrelia garinii
VKNSVVAPAVVKSE

SEQ ID NO: 212439 - protein, 14 aa, Borrelia garinii
KNSVVAPAVVKSES

SEQ ID NO: 212440 - protein, 14 aa, Borrelia garinii
NSVVAPAVVKSESK

SEQ ID NO: 212441 - protein, 14 aa, Borrelia garinii
SVVAPAVVKSESKR

SEQ ID NO: 212442 - protein, 14 aa, Borrelia garinii
VVAPAVVKSESKRY

SEQ ID NO: 212443 - protein, 14 aa, Borrelia garinii
VAPAVVKSESKRYA

SEQ ID NO: 212444 - protein, 14 aa, Borrelia garinii
APAVVKSESKRYAG

SEQ ID NO: 212445 - protein, 14 aa, Borrelia garinii
PAVVKSESKRYAGD

SEQ ID NO: 212446 - protein, 14 aa, Borrelia garinii
AVVKSESKRYAGDT

SEQ ID NO: 212447 - protein, 14 aa, Borrelia garinii
VVKSESKRYAGDTI

SEQ ID NO: 212448 - protein, 14 aa, Borrelia garinii
VKSESKRYAGDTIL

SEQ ID NO: 212449 - protein, 14 aa, Borrelia garinii
KSESKRYAGDTILG

SEQ ID NO: 212450 - protein, 14 aa, Borrelia garinii
SESKRYAGDTILGV

SEQ ID NO: 212451 - protein, 14 aa, Borrelia garinii
ESKRYAGDTILGVR

SEQ ID NO: 212452 - protein, 14 aa, Borrelia garinii
SKRYAGDTILGVRV

SEQ ID NO: 212453 - protein, 14 aa, Borrelia garinii
KRYAGDTILGVRVL

SEQ ID NO: 212454 - protein, 14 aa, Borrelia garinii
RYAGDTILGVRVLF

SEQ ID NO: 212455 - protein, 14 aa, Borrelia garinii
YAGDTILGVRVLFP

SEQ ID NO: 212456 - protein, 14 aa, Borrelia garinii
AGDTILGVRVLFPS

SEQ ID NO: 212457 - protein, 14 aa, Borrelia garinii
GDTILGVRVLFPSY

SEQ ID NO: 212458 - protein, 14 aa, Borrelia garinii
DTILGVRVLFPSYS

SEQ ID NO: 212459 - protein, 14 aa, Borrelia garinii
TILGVRVLFPSYSQ

SEQ ID NO: 212460 - protein, 14 aa, Borrelia garinii
ILGVRVLFPSYSQS

SEQ ID NO: 212461 - protein, 14 aa, Borrelia garinii
LGVRVLFPSYSQSS

SEQ ID NO: 212462 - protein, 14 aa, Borrelia garinii
GVRVLFPSYSQSSA

SEQ ID NO: 212463 - protein, 14 aa, Borrelia garinii
VRVLFPSYSQSSAM

SEQ ID NO: 212464 - protein, 14 aa, Borrelia garinii
RVLFPSYSQSSAMI

SEQ ID NO: 212465 - protein, 14 aa, Borrelia garinii
VLFPSYSQSSAMIM

SEQ ID NO: 212466 - protein, 14 aa, Borrelia garinii
LFPSYSQSSAMIMP

SEQ ID NO: 212467 - protein, 14 aa, Borrelia garinii
FPSYSQSSAMIMPP

SEQ ID NO: 212468 - protein, 14 aa, Borrelia garinii
PSYSQSSAMIMPPF

SEQ ID NO: 212469 - protein, 14 aa, Borrelia garinii
SYSQSSAMIMPPFK

SEQ ID NO: 212470 - protein, 14 aa, Borrelia garinii
YSQSSAMIMPPFKI

SEQ ID NO: 212471 - protein, 14 aa, Borrelia garinii
SQSSAMIMPPFKIP

SEQ ID NO: 212472 - protein, 14 aa, Borrelia garinii
QSSAMIMPPFKIPF

SEQ ID NO: 212473 - protein, 14 aa, Borrelia garinii
SSAMIMPPFKIPFY

SEQ ID NO: 212474 - protein, 14 aa, Borrelia garinii
SAMIMPPFKIPFYS

SEQ ID NO: 212475 - protein, 14 aa, Borrelia garinii
AMIMPPFKIPFYSG

SEQ ID NO: 212476 - protein, 14 aa, Borrelia garinii
MIMPPFKIPFYSGE

SEQ ID NO: 212477 - protein, 14 aa, Borrelia garinii
IMPPFKIPFYSGEN

SEQ ID NO: 212478 - protein, 14 aa, Borrelia garinii
MPPFKIPFYSGENG

SEQ ID NO: 212479 - protein, 14 aa, Borrelia garinii
PPFKIPFYSGENGN

SEQ ID NO: 212480 - protein, 14 aa, Borrelia garinii
PFKIPFYSGENGNQ

SEQ ID NO: 212481 - protein, 14 aa, Borrelia garinii
FKIPFYSGENGNQF

SEQ ID NO: 212482 - protein, 14 aa, Borrelia garinii
KIPFYSGENGNQFL

SEQ ID NO: 212483 - protein, 14 aa, Borrelia garinii
IPFYSGENGNQFLG

SEQ ID NO: 212484 - protein, 14 aa, Borrelia garinii
PFYSGENGNQFLGK

SEQ ID NO: 212485 - protein, 14 aa, Borrelia garinii
FYSGENGNQFLGKG

SEQ ID NO: 212486 - protein, 14 aa, Borrelia garinii
YSGENGNQFLGKGL

SEQ ID NO: 212487 - protein, 14 aa, Borrelia garinii
SGENGNQFLGKGLI

SEQ ID NO: 212488 - protein, 14 aa, Borrelia garinii
GENGNQFLGKGLIN

SEQ ID NO: 212489 - protein, 14 aa, Borrelia garinii
ENGNQFLGKGLINN

SEQ ID NO: 212490 - protein, 14 aa, Borrelia garinii
NGNQFLGKGLINNI

SEQ ID NO: 212491 - protein, 14 aa, Borrelia garinii
GNQFLGKGLINNIK

SEQ ID NO: 212492 - protein, 14 aa, Borrelia garinii
NQFLGKGLINNIKT

SEQ ID NO: 212493 - protein, 14 aa, Borrelia garinii
QFLGKGLINNIKTM

SEQ ID NO: 212494 - protein, 14 aa, Borrelia garinii
FLGKGLINNIKTMK

SEQ ID NO: 212495 - protein, 14 aa, Borrelia garinii
LGKGLINNIKTMKE

SEQ ID NO: 212496 - protein, 14 aa, Borrelia garinii
GKGLINNIKTMKEI

SEQ ID NO: 212497 - protein, 14 aa, Borrelia garinii
KGLINNIKTMKEIK

SEQ ID NO: 212498 - protein, 14 aa, Borrelia garinii
GLINNIKTMKEIKV

SEQ ID NO: 212499 - protein, 14 aa, Borrelia garinii
LINNIKTMKEIKVS

SEQ ID NO: 212500 - protein, 14 aa, Borrelia garinii
INNIKTMKEIKVSV

SEQ ID NO: 212501 - protein, 14 aa, Borrelia garinii
NNIKTMKEIKVSVY

SEQ ID NO: 212502 - protein, 14 aa, Borrelia garinii
NIKTMKEIKVSVYS

SEQ ID NO: 212503 - protein, 14 aa, Borrelia garinii
IKTMKEIKVSVYSL

SEQ ID NO: 212504 - protein, 14 aa, Borrelia garinii
KTMKEIKVSVYSLG

SEQ ID NO: 212505 - protein, 14 aa, Borrelia garinii
TMKEIKVSVYSLGY

SEQ ID NO: 212506 - protein, 14 aa, Borrelia garinii
MKEIKVSVYSLGYE

SEQ ID NO: 212507 - protein, 14 aa, Borrelia garinii
KEIKVSVYSLGYEI

SEQ ID NO: 212508 - protein, 14 aa, Borrelia garinii
EIKVSVYSLGYEID

SEQ ID NO: 212509 - protein, 14 aa, Borrelia garinii
IKVSVYSLGYEIDL

SEQ ID NO: 212510 - protein, 14 aa, Borrelia garinii
KVSVYSLGYEIDLE

SEQ ID NO: 212511 - protein, 14 aa, Borrelia garinii
VSVYSLGYEIDLEV

SEQ ID NO: 212512 - protein, 14 aa, Borrelia garinii
SVYSLGYEIDLEVL

SEQ ID NO: 212513 - protein, 14 aa, Borrelia garinii
VYSLGYEIDLEVLF

SEQ ID NO: 212514 - protein, 14 aa, Borrelia garinii
YSLGYEIDLEVLFE

SEQ ID NO: 212515 - protein, 14 aa, Borrelia garinii
SLGYEIDLEVLFED

SEQ ID NO: 212516 - protein, 14 aa, Borrelia garinii
LGYEIDLEVLFEDM

SEQ ID NO: 212517 - protein, 14 aa, Borrelia garinii
GYEIDLEVLFEDMN

SEQ ID NO: 212518 - protein, 14 aa, Borrelia garinii
YEIDLEVLFEDMNG

SEQ ID NO: 212519 - protein, 14 aa, Borrelia garinii
EIDLEVLFEDMNGM

SEQ ID NO: 212520 - protein, 14 aa, Borrelia garinii
IDLEVLFEDMNGME

SEQ ID NO: 212521 - protein, 14 aa, Borrelia garinii
DLEVLFEDMNGMEY

SEQ ID NO: 212522 - protein, 14 aa, Borrelia garinii
LEVLFEDMNGMEYA

SEQ ID NO: 212523 - protein, 14 aa, Borrelia garinii
EVLFEDMNGMEYAY

SEQ ID NO: 212524 - protein, 14 aa, Borrelia garinii
VLFEDMNGMEYAYS

SEQ ID NO: 212525 - protein, 14 aa, Borrelia garinii
LFEDMNGMEYAYSL

SEQ ID NO: 212526 - protein, 14 aa, Borrelia garinii
FEDMNGMEYAYSLG

SEQ ID NO: 212527 - protein, 14 aa, Borrelia garinii
EDMNGMEYAYSLGT

SEQ ID NO: 212528 - protein, 14 aa, Borrelia garinii
DMNGMEYAYSLGTL

SEQ ID NO: 212529 - protein, 14 aa, Borrelia garinii
MNGMEYAYSLGTLK

SEQ ID NO: 212530 - protein, 14 aa, Borrelia garinii
NGMEYAYSLGTLKF

SEQ ID NO: 212531 - protein, 14 aa, Borrelia garinii
GMEYAYSLGTLKFK

SEQ ID NO: 212532 - protein, 14 aa, Borrelia garinii
MEYAYSLGTLKFKG

SEQ ID NO: 212533 - protein, 14 aa, Borrelia garinii
EYAYSLGTLKFKGW

SEQ ID NO: 212534 - protein, 14 aa, Borrelia garinii
YAYSLGTLKFKGWA

SEQ ID NO: 212535 - protein, 14 aa, Borrelia garinii
AYSLGTLKFKGWAD

SEQ ID NO: 212536 - protein, 14 aa, Borrelia garinii
YSLGTLKFKGWADL

SEQ ID NO: 212537 - protein, 14 aa, Borrelia garinii
SLGTLKFKGWADLI

SEQ ID NO: 212538 - protein, 14 aa, Borrelia garinii
LGTLKFKGWADLIW

SEQ ID NO: 212539 - protein, 14 aa, Borrelia garinii
GTLKFKGWADLIWS

SEQ ID NO: 212540 - protein, 14 aa, Borrelia garinii
TLKFKGWADLIWSN

SEQ ID NO: 212541 - protein, 14 aa, Borrelia garinii
LKFKGWADLIWSNP

SEQ ID NO: 212542 - protein, 14 aa, Borrelia garinii
KFKGWADLIWSNPN

SEQ ID NO: 212543 - protein, 14 aa, Borrelia garinii
FKGWADLIWSNPNY

SEQ ID NO: 212544 - protein, 14 aa, Borrelia garinii
KGWADLIWSNPNYI

SEQ ID NO: 212545 - protein, 14 aa, Borrelia garinii
GWADLIWSNPNYIP

SEQ ID NO: 212546 - protein, 14 aa, Borrelia garinii
WADLIWSNPNYIPN

SEQ ID NO: 212547 - protein, 14 aa, Borrelia garinii
ADLIWSNPNYIPNI

SEQ ID NO: 212548 - protein, 14 aa, Borrelia garinii
DLIWSNPNYIPNIS

SEQ ID NO: 212549 - protein, 14 aa, Borrelia garinii
LIWSNPNYIPNISS

SEQ ID NO: 212550 - protein, 14 aa, Borrelia garinii
IWSNPNYIPNISSR

SEQ ID NO: 212551 - protein, 14 aa, Borrelia garinii
WSNPNYIPNISSRI

SEQ ID NO: 212552 - protein, 14 aa, Borrelia garinii
SNPNYIPNISSRII

SEQ ID NO: 212553 - protein, 14 aa, Borrelia garinii
NPNYIPNISSRIIK

SEQ ID NO: 212554 - protein, 14 aa, Borrelia garinii
PNYIPNISSRIIKD

SEQ ID NO: 212555 - protein, 14 aa, Borrelia garinii
NYIPNISSRIIKDD

SEQ ID NO: 212556 - protein, 14 aa, Borrelia garinii
YIPNISSRIIKDDV

SEQ ID NO: 212557 - protein, 14 aa, Borrelia garinii
IPNISSRIIKDDVP

SEQ ID NO: 212558 - protein, 14 aa, Borrelia garinii
PNISSRIIKDDVPN

SEQ ID NO: 212559 - protein, 14 aa, Borrelia garinii
NISSRIIKDDVPNY

SEQ ID NO: 212560 - protein, 14 aa, Borrelia garinii
ISSRIIKDDVPNYP

SEQ ID NO: 212561 - protein, 14 aa, Borrelia garinii
SSRIIKDDVPNYPL

SEQ ID NO: 212562 - protein, 14 aa, Borrelia garinii
SRIIKDDVPNYPLA

SEQ ID NO: 212563 - protein, 14 aa, Borrelia garinii
RIIKDDVPNYPLAS

SEQ ID NO: 212564 - protein, 14 aa, Borrelia garinii
IIKDDVPNYPLASS

SEQ ID NO: 212565 - protein, 14 aa, Borrelia garinii
IKDDVPNYPLASSK

SEQ ID NO: 212566 - protein, 14 aa, Borrelia garinii
KDDVPNYPLASSKM

SEQ ID NO: 212567 - protein, 14 aa, Borrelia garinii
DDVPNYPLASSKMR

SEQ ID NO: 212568 - protein, 14 aa, Borrelia garinii
DVPNYPLASSKMRF

SEQ ID NO: 212569 - protein, 14 aa, Borrelia garinii
VPNYPLASSKMRFK

SEQ ID NO: 212570 - protein, 14 aa, Borrelia garinii
PNYPLASSKMRFKA

SEQ ID NO: 212571 - protein, 14 aa, Borrelia garinii
NYPLASSKMRFKAF

SEQ ID NO: 212572 - protein, 14 aa, Borrelia garinii
YPLASSKMRFKAFR

SEQ ID NO: 212573 - protein, 14 aa, Borrelia garinii
PLASSKMRFKAFRV

SEQ ID NO: 212574 - protein, 14 aa, Borrelia garinii
LASSKMRFKAFRVS

SEQ ID NO: 212575 - protein, 14 aa, Borrelia garinii
ASSKMRFKAFRVSK

SEQ ID NO: 212576 - protein, 14 aa, Borrelia garinii
SSKMRFKAFRVSKS

SEQ ID NO: 212577 - protein, 14 aa, Borrelia garinii
SKMRFKAFRVSKSH

SEQ ID NO: 212578 - protein, 14 aa, Borrelia garinii
KMRFKAFRVSKSHS

SEQ ID NO: 212579 - protein, 14 aa, Borrelia garinii
MRFKAFRVSKSHSS

SEQ ID NO: 212580 - protein, 14 aa, Borrelia garinii
RFKAFRVSKSHSSK

SEQ ID NO: 212581 - protein, 14 aa, Borrelia garinii
FKAFRVSKSHSSKE

SEQ ID NO: 212582 - protein, 14 aa, Borrelia garinii
KAFRVSKSHSSKEQ

SEQ ID NO: 212583 - protein, 14 aa, Borrelia garinii
AFRVSKSHSSKEQN

SEQ ID NO: 212584 - protein, 14 aa, Borrelia garinii
FRVSKSHSSKEQNF

SEQ ID NO: 212585 - protein, 14 aa, Borrelia garinii
RVSKSHSSKEQNFI

SEQ ID NO: 212586 - protein, 14 aa, Borrelia garinii
VSKSHSSKEQNFIF

SEQ ID NO: 212587 - protein, 14 aa, Borrelia garinii
SKSHSSKEQNFIFY

SEQ ID NO: 212588 - protein, 14 aa, Borrelia garinii
KSHSSKEQNFIFYV

SEQ ID NO: 212589 - protein, 14 aa, Borrelia garinii
SHSSKEQNFIFYVK

SEQ ID NO: 212590 - protein, 14 aa, Borrelia garinii
HSSKEQNFIFYVKD

SEQ ID NO: 212591 - protein, 14 aa, Borrelia garinii
SSKEQNFIFYVKDL

SEQ ID NO: 212592 - protein, 14 aa, Borrelia garinii
SKEQNFIFYVKDLR

SEQ ID NO: 212593 - protein, 14 aa, Borrelia garinii
KEQNFIFYVKDLRV

SEQ ID NO: 212594 - protein, 14 aa, Borrelia garinii
EQNFIFYVKDLRVL

SEQ ID NO: 212595 - protein, 14 aa, Borrelia garinii
QNFIFYVKDLRVLY

SEQ ID NO: 212596 - protein, 14 aa, Borrelia garinii
NFIFYVKDLRVLYD

SEQ ID NO: 212597 - protein, 14 aa, Borrelia garinii
FIFYVKDLRVLYDK

SEQ ID NO: 212598 - protein, 14 aa, Borrelia garinii
IFYVKDLRVLYDKL

SEQ ID NO: 212599 - protein, 14 aa, Borrelia garinii
FYVKDLRVLYDKLS

SEQ ID NO: 212600 - protein, 14 aa, Borrelia garinii
YVKDLRVLYDKLSV

SEQ ID NO: 212601 - protein, 14 aa, Borrelia garinii
VKDLRVLYDKLSVS

SEQ ID NO: 212602 - protein, 14 aa, Borrelia garinii
KDLRVLYDKLSVSI

SEQ ID NO: 212603 - protein, 14 aa, Borrelia garinii
DLRVLYDKLSVSID

SEQ ID NO: 212604 - protein, 14 aa, Borrelia garinii
LRVLYDKLSVSIDS

SEQ ID NO: 212605 - protein, 14 aa, Borrelia garinii
RVLYDKLSVSIDSD

SEQ ID NO: 212606 - protein, 14 aa, Borrelia garinii
VLYDKLSVSIDSDI

SEQ ID NO: 212607 - protein, 14 aa, Borrelia garinii
LYDKLSVSIDSDID

SEQ ID NO: 212608 - protein, 14 aa, Borrelia garinii
YDKLSVSIDSDIDS

SEQ ID NO: 212609 - protein, 14 aa, Borrelia garinii
DKLSVSIDSDIDSE

SEQ ID NO: 212610 - protein, 14 aa, Borrelia garinii
KLSVSIDSDIDSES

SEQ ID NO: 212611 - protein, 14 aa, Borrelia garinii
LSVSIDSDIDSESV

SEQ ID NO: 212612 - protein, 14 aa, Borrelia garinii
SVSIDSDIDSESVF

SEQ ID NO: 212613 - protein, 14 aa, Borrelia garinii
VSIDSDIDSESVFK

SEQ ID NO: 212614 - protein, 14 aa, Borrelia garinii
SIDSDIDSESVFKV

SEQ ID NO: 212615 - protein, 14 aa, Borrelia garinii
IDSDIDSESVFKVY

SEQ ID NO: 212616 - protein, 14 aa, Borrelia garinii
DSDIDSESVFKVYE

SEQ ID NO: 212617 - protein, 14 aa, Borrelia garinii
SDIDSESVFKVYET

SEQ ID NO: 212618 - protein, 14 aa, Borrelia garinii
DIDSESVFKVYETS

SEQ ID NO: 212619 - protein, 14 aa, Borrelia garinii
IDSESVFKVYETSG

SEQ ID NO: 212620 - protein, 14 aa, Borrelia garinii
DSESVFKVYETSGT

SEQ ID NO: 212621 - protein, 14 aa, Borrelia garinii
SESVFKVYETSGTE

SEQ ID NO: 212622 - protein, 14 aa, Borrelia garinii
ESVFKVYETSGTES

SEQ ID NO: 212623 - protein, 14 aa, Borrelia garinii
SVFKVYETSGTESL

SEQ ID NO: 212624 - protein, 14 aa, Borrelia garinii
VFKVYETSGTESLR

SEQ ID NO: 212625 - protein, 14 aa, Borrelia garinii
FKVYETSGTESLRK

SEQ ID NO: 212626 - protein, 14 aa, Borrelia garinii
KVYETSGTESLRKL

SEQ ID NO: 212627 - protein, 14 aa, Borrelia garinii
VYETSGTESLRKLK

SEQ ID NO: 212628 - protein, 14 aa, Borrelia garinii
YETSGTESLRKLKA

SEQ ID NO: 212629 - protein, 14 aa, Borrelia garinii
ETSGTESLRKLKAH

SEQ ID NO: 212630 - protein, 14 aa, Borrelia garinii
TSGTESLRKLKAHE

SEQ ID NO: 212631 - protein, 14 aa, Borrelia garinii
SGTESLRKLKAHET

SEQ ID NO: 212632 - protein, 14 aa, Borrelia garinii
GTESLRKLKAHETF

SEQ ID NO: 212633 - protein, 14 aa, Borrelia garinii
TESLRKLKAHETFK

SEQ ID NO: 212634 - protein, 14 aa, Borrelia garinii
ESLRKLKAHETFKR

SEQ ID NO: 212635 - protein, 14 aa, Borrelia garinii
SLRKLKAHETFKRV

SEQ ID NO: 212636 - protein, 14 aa, Borrelia garinii
LRKLKAHETFKRVL

SEQ ID NO: 212637 - protein, 14 aa, Borrelia garinii
RKLKAHETFKRVLK

SEQ ID NO: 212638 - protein, 14 aa, Borrelia garinii
KLKAHETFKRVLKL

SEQ ID NO: 212639 - protein, 14 aa, Borrelia garinii
LKAHETFKRVLKLR

SEQ ID NO: 212640 - protein, 14 aa, Borrelia garinii
KAHETFKRVLKLRE

SEQ ID NO: 212641 - protein, 14 aa, Borrelia garinii
AHETFKRVLKLREK

SEQ ID NO: 212642 - protein, 14 aa, Borrelia garinii
HETFKRVLKLREKI

SEQ ID NO: 212643 - protein, 14 aa, Borrelia garinii
ETFKRVLKLREKIS

SEQ ID NO: 212644 - protein, 14 aa, Borrelia garinii
TFKRVLKLREKISM

SEQ ID NO: 212645 - protein, 14 aa, Borrelia garinii
FKRVLKLREKISMP

SEQ ID NO: 212646 - protein, 14 aa, Borrelia garinii
KRVLKLREKISMPE

SEQ ID NO: 212647 - protein, 14 aa, Borrelia garinii
RVLKLREKISMPEG

SEQ ID NO: 212648 - protein, 14 aa, Borrelia garinii
VLKLREKISMPEGS

SEQ ID NO: 212649 - protein, 14 aa, Borrelia garinii
LKLREKISMPEGSF

SEQ ID NO: 212650 - protein, 14 aa, Borrelia garinii
KLREKISMPEGSFQ

SEQ ID NO: 212651 - protein, 14 aa, Borrelia garinii
LREKISMPEGSFQN

SEQ ID NO: 212652 - protein, 14 aa, Borrelia garinii
REKISMPEGSFQNF

SEQ ID NO: 212653 - protein, 14 aa, Borrelia garinii
EKISMPEGSFQNFI

SEQ ID NO: 212654 - protein, 14 aa, Borrelia garinii
KISMPEGSFQNFIE

SEQ ID NO: 212655 - protein, 14 aa, Borrelia garinii
ISMPEGSFQNFIEK

SEQ ID NO: 212656 - protein, 14 aa, Borrelia garinii
SMPEGSFQNFIEKV

SEQ ID NO: 212657 - protein, 14 aa, Borrelia garinii
MPEGSFQNFIEKVE

SEQ ID NO: 212658 - protein, 14 aa, Borrelia garinii
PEGSFQNFIEKVES

SEQ ID NO: 212659 - protein, 14 aa, Borrelia garinii
EGSFQNFIEKVESE

SEQ ID NO: 212660 - protein, 14 aa, Borrelia garinii
GSFQNFIEKVESEK

SEQ ID NO: 212661 - protein, 14 aa, Borrelia garinii
SFQNFIEKVESEKK

SEQ ID NO: 212662 - protein, 14 aa, Borrelia garinii
FQNFIEKVESEKKP

SEQ ID NO: 212663 - protein, 14 aa, Borrelia garinii
QNFIEKVESEKKPE

SEQ ID NO: 212664 - protein, 14 aa, Borrelia garinii
NFIEKVESEKKPEE

SEQ ID NO: 212665 - protein, 14 aa, Borrelia garinii
FIEKVESEKKPEES

SEQ ID NO: 212666 - protein, 14 aa, Borrelia garinii
IEKVESEKKPEESS

SEQ ID NO: 212667 - protein, 14 aa, Borrelia garinii
EKVESEKKPEESSL

SEQ ID NO: 212668 - protein, 14 aa, Borrelia garinii
KVESEKKPEESSLK

SEQ ID NO: 212669 - protein, 14 aa, Borrelia garinii
VESEKKPEESSLKK

SEQ ID NO: 212670 - protein, 15 aa, Borrelia garinii
MKRKAKSILLFLLST

SEQ ID NO: 212671 - protein, 15 aa, Borrelia garinii
KRKAKSILLFLLSTA

SEQ ID NO: 212672 - protein, 15 aa, Borrelia garinii
RKAKSILLFLLSTAL

SEQ ID NO: 212673 - protein, 15 aa, Borrelia garinii
KAKSILLFLLSTALF

SEQ ID NO: 212674 - protein, 15 aa, Borrelia garinii
AKSILLFLLSTALFA

SEQ ID NO: 212675 - protein, 15 aa, Borrelia garinii
KSILLFLLSTALFAQ

SEQ ID NO: 212676 - protein, 15 aa, Borrelia garinii
SILLFLLSTALFAQE

SEQ ID NO: 212677 - protein, 15 aa, Borrelia garinii
ILLFLLSTALFAQET

SEQ ID NO: 212678 - protein, 15 aa, Borrelia garinii
LLFLLSTALFAQETD

SEQ ID NO: 212679 - protein, 15 aa, Borrelia garinii
LFLLSTALFAQETDG

SEQ ID NO: 212680 - protein, 15 aa, Borrelia garinii
FLLSTALFAQETDGL

SEQ ID NO: 212681 - protein, 15 aa, Borrelia garinii
LLSTALFAQETDGLP

SEQ ID NO: 212682 - protein, 15 aa, Borrelia garinii
LSTALFAQETDGLPE

SEQ ID NO: 212683 - protein, 15 aa, Borrelia garinii
STALFAQETDGLPEG

SEQ ID NO: 212684 - protein, 15 aa, Borrelia garinii
TALFAQETDGLPEGS

SEQ ID NO: 212685 - protein, 15 aa, Borrelia garinii
ALFAQETDGLPEGSK

SEQ ID NO: 212686 - protein, 15 aa, Borrelia garinii
LFAQETDGLPEGSKR

SEQ ID NO: 212687 - protein, 15 aa, Borrelia garinii
FAQETDGLPEGSKRS

SEQ ID NO: 212688 - protein, 15 aa, Borrelia garinii
AQETDGLPEGSKRSE

SEQ ID NO: 212689 - protein, 15 aa, Borrelia garinii
QETDGLPEGSKRSEP

SEQ ID NO: 212690 - protein, 15 aa, Borrelia garinii
ETDGLPEGSKRSEPG

SEQ ID NO: 212691 - protein, 15 aa, Borrelia garinii
TDGLPEGSKRSEPGE

SEQ ID NO: 212692 - protein, 15 aa, Borrelia garinii
DGLPEGSKRSEPGEL

SEQ ID NO: 212693 - protein, 15 aa, Borrelia garinii
GLPEGSKRSEPGELV

SEQ ID NO: 212694 - protein, 15 aa, Borrelia garinii
LPEGSKRSEPGELVL

SEQ ID NO: 212695 - protein, 15 aa, Borrelia garinii
PEGSKRSEPGELVLD

SEQ ID NO: 212696 - protein, 15 aa, Borrelia garinii
EGSKRSEPGELVLDF

SEQ ID NO: 212697 - protein, 15 aa, Borrelia garinii
GSKRSEPGELVLDFA

SEQ ID NO: 212698 - protein, 15 aa, Borrelia garinii
SKRSEPGELVLDFAE

SEQ ID NO: 212699 - protein, 15 aa, Borrelia garinii
KRSEPGELVLDFAEL

SEQ ID NO: 212700 - protein, 15 aa, Borrelia garinii
RSEPGELVLDFAELA

SEQ ID NO: 212701 - protein, 15 aa, Borrelia garinii
SEPGELVLDFAELAR

SEQ ID NO: 212702 - protein, 15 aa, Borrelia garinii
EPGELVLDFAELARD

SEQ ID NO: 212703 - protein, 15 aa, Borrelia garinii
PGELVLDFAELARDP

SEQ ID NO: 212704 - protein, 15 aa, Borrelia garinii
GELVLDFAELARDPS

SEQ ID NO: 212705 - protein, 15 aa, Borrelia garinii
ELVLDFAELARDPSS

SEQ ID NO: 212706 - protein, 15 aa, Borrelia garinii
LVLDFAELARDPSST

SEQ ID NO: 212707 - protein, 15 aa, Borrelia garinii
VLDFAELARDPSSTK

SEQ ID NO: 212708 - protein, 15 aa, Borrelia garinii
LDFAELARDPSSTKL

SEQ ID NO: 212709 - protein, 15 aa, Borrelia garinii
DFAELARDPSSTKLD

SEQ ID NO: 212710 - protein, 15 aa, Borrelia garinii
FAELARDPSSTKLDL

SEQ ID NO: 212711 - protein, 15 aa, Borrelia garinii
AELARDPSSTKLDLT

SEQ ID NO: 212712 - protein, 15 aa, Borrelia garinii
ELARDPSSTKLDLTN

SEQ ID NO: 212713 - protein, 15 aa, Borrelia garinii
LARDPSSTKLDLTNY

SEQ ID NO: 212714 - protein, 15 aa, Borrelia garinii
ARDPSSTKLDLTNYV

SEQ ID NO: 212715 - protein, 15 aa, Borrelia garinii
RDPSSTKLDLTNYVD

SEQ ID NO: 212716 - protein, 15 aa, Borrelia garinii
DPSSTKLDLTNYVDY

SEQ ID NO: 212717 - protein, 15 aa, Borrelia garinii
PSSTKLDLTNYVDYV

SEQ ID NO: 212718 - protein, 15 aa, Borrelia garinii
SSTKLDLTNYVDYVY

SEQ ID NO: 212719 - protein, 15 aa, Borrelia garinii
STKLDLTNYVDYVYS

SEQ ID NO: 212720 - protein, 15 aa, Borrelia garinii
TKLDLTNYVDYVYSG

SEQ ID NO: 212721 - protein, 15 aa, Borrelia garinii
KLDLTNYVDYVYSGA

SEQ ID NO: 212722 - protein, 15 aa, Borrelia garinii
LDLTNYVDYVYSGAS

SEQ ID NO: 212723 - protein, 15 aa, Borrelia garinii
DLTNYVDYVYSGASG

SEQ ID NO: 212724 - protein, 15 aa, Borrelia garinii
LTNYVDYVYSGASGI

SEQ ID NO: 212725 - protein, 15 aa, Borrelia garinii
TNYVDYVYSGASGIV

SEQ ID NO: 212726 - protein, 15 aa, Borrelia garinii
NYVDYVYSGASGIVK

SEQ ID NO: 212727 - protein, 15 aa, Borrelia garinii
YVDYVYSGASGIVKP

SEQ ID NO: 212728 - protein, 15 aa, Borrelia garinii
VDYVYSGASGIVKPE

SEQ ID NO: 212729 - protein, 15 aa, Borrelia garinii
DYVYSGASGIVKPED

SEQ ID NO: 212730 - protein, 15 aa, Borrelia garinii
YVYSGASGIVKPEDM

SEQ ID NO: 212731 - protein, 15 aa, Borrelia garinii
VYSGASGIVKPEDMV

SEQ ID NO: 212732 - protein, 15 aa, Borrelia garinii
YSGASGIVKPEDMVV

SEQ ID NO: 212733 - protein, 15 aa, Borrelia garinii
SGASGIVKPEDMVVD

SEQ ID NO: 212734 - protein, 15 aa, Borrelia garinii
GASGIVKPEDMVVDL

SEQ ID NO: 212735 - protein, 15 aa, Borrelia garinii
ASGIVKPEDMVVDLG

SEQ ID NO: 212736 - protein, 15 aa, Borrelia garinii
SGIVKPEDMVVDLGI

SEQ ID NO: 212737 - protein, 15 aa, Borrelia garinii
GIVKPEDMVVDLGIN

SEQ ID NO: 212738 - protein, 15 aa, Borrelia garinii
IVKPEDMVVDLGINN

SEQ ID NO: 212739 - protein, 15 aa, Borrelia garinii
VKPEDMVVDLGINNW

SEQ ID NO: 212740 - protein, 15 aa, Borrelia garinii
KPEDMVVDLGINNWS

SEQ ID NO: 212741 - protein, 15 aa, Borrelia garinii
PEDMVVDLGINNWSV

SEQ ID NO: 212742 - protein, 15 aa, Borrelia garinii
EDMVVDLGINNWSVL

SEQ ID NO: 212743 - protein, 15 aa, Borrelia garinii
DMVVDLGINNWSVLL

SEQ ID NO: 212744 - protein, 15 aa, Borrelia garinii
MVVDLGINNWSVLLT

SEQ ID NO: 212745 - protein, 15 aa, Borrelia garinii
VVDLGINNWSVLLTP

SEQ ID NO: 212746 - protein, 15 aa, Borrelia garinii
VDLGINNWSVLLTPS

SEQ ID NO: 212747 - protein, 15 aa, Borrelia garinii
DLGINNWSVLLTPSA

SEQ ID NO: 212748 - protein, 15 aa, Borrelia garinii
LGINNWSVLLTPSAR

SEQ ID NO: 212749 - protein, 15 aa, Borrelia garinii
GINNWSVLLTPSARL

SEQ ID NO: 212750 - protein, 15 aa, Borrelia garinii
INNWSVLLTPSARLQ

SEQ ID NO: 212751 - protein, 15 aa, Borrelia garinii
NNWSVLLTPSARLQA

SEQ ID NO: 212752 - protein, 15 aa, Borrelia garinii
NWSVLLTPSARLQAY

SEQ ID NO: 212753 - protein, 15 aa, Borrelia garinii
WSVLLTPSARLQAYV

SEQ ID NO: 212754 - protein, 15 aa, Borrelia garinii
SVLLTPSARLQAYVK

SEQ ID NO: 212755 - protein, 15 aa, Borrelia garinii
VLLTPSARLQAYVKN

SEQ ID NO: 212756 - protein, 15 aa, Borrelia garinii
LLTPSARLQAYVKNS

SEQ ID NO: 212757 - protein, 15 aa, Borrelia garinii
LTPSARLQAYVKNSV

SEQ ID NO: 212758 - protein, 15 aa, Borrelia garinii
TPSARLQAYVKNSVV

SEQ ID NO: 212759 - protein, 15 aa, Borrelia garinii
PSARLQAYVKNSVVA

SEQ ID NO: 212760 - protein, 15 aa, Borrelia garinii
SARLQAYVKNSVVAP

SEQ ID NO: 212761 - protein, 15 aa, Borrelia garinii
ARLQAYVKNSVVAPA

SEQ ID NO: 212762 - protein, 15 aa, Borrelia garinii
RLQAYVKNSVVAPAV

SEQ ID NO: 212763 - protein, 15 aa, Borrelia garinii
LQAYVKNSVVAPAVV

SEQ ID NO: 212764 - protein, 15 aa, Borrelia garinii
QAYVKNSVVAPAVVK

SEQ ID NO: 212765 - protein, 15 aa, Borrelia garinii
AYVKNSVVAPAVVKS

SEQ ID NO: 212766 - protein, 15 aa, Borrelia garinii
YVKNSVVAPAVVKSE

SEQ ID NO: 212767 - protein, 15 aa, Borrelia garinii
VKNSVVAPAVVKSES

SEQ ID NO: 212768 - protein, 15 aa, Borrelia garinii
KNSVVAPAVVKSESK

SEQ ID NO: 212769 - protein, 15 aa, Borrelia garinii
NSVVAPAVVKSESKR

SEQ ID NO: 212770 - protein, 15 aa, Borrelia garinii
SVVAPAVVKSESKRY

SEQ ID NO: 212771 - protein, 15 aa, Borrelia garinii
VVAPAVVKSESKRYA

SEQ ID NO: 212772 - protein, 15 aa, Borrelia garinii
VAPAVVKSESKRYAG

SEQ ID NO: 212773 - protein, 15 aa, Borrelia garinii
APAVVKSESKRYAGD

SEQ ID NO: 212774 - protein, 15 aa, Borrelia garinii
PAVVKSESKRYAGDT

SEQ ID NO: 212775 - protein, 15 aa, Borrelia garinii
AVVKSESKRYAGDTI

SEQ ID NO: 212776 - protein, 15 aa, Borrelia garinii
VVKSESKRYAGDTIL

SEQ ID NO: 212777 - protein, 15 aa, Borrelia garinii
VKSESKRYAGDTILG

SEQ ID NO: 212778 - protein, 15 aa, Borrelia garinii
KSESKRYAGDTILGV

SEQ ID NO: 212779 - protein, 15 aa, Borrelia garinii
SESKRYAGDTILGVR

SEQ ID NO: 212780 - protein, 15 aa, Borrelia garinii
ESKRYAGDTILGVRV

SEQ ID NO: 212781 - protein, 15 aa, Borrelia garinii
SKRYAGDTILGVRVL

SEQ ID NO: 212782 - protein, 15 aa, Borrelia garinii
KRYAGDTILGVRVLF

SEQ ID NO: 212783 - protein, 15 aa, Borrelia garinii
RYAGDTILGVRVLFP

SEQ ID NO: 212784 - protein, 15 aa, Borrelia garinii
YAGDTILGVRVLFPS

SEQ ID NO: 212785 - protein, 15 aa, Borrelia garinii
AGDTILGVRVLFPSY

SEQ ID NO: 212786 - protein, 15 aa, Borrelia garinii
GDTILGVRVLFPSYS

SEQ ID NO: 212787 - protein, 15 aa, Borrelia garinii
DTILGVRVLFPSYSQ

SEQ ID NO: 212788 - protein, 15 aa, Borrelia garinii
TILGVRVLFPSYSQS

SEQ ID NO: 212789 - protein, 15 aa, Borrelia garinii
ILGVRVLFPSYSQSS

SEQ ID NO: 212790 - protein, 15 aa, Borrelia garinii
LGVRVLFPSYSQSSA

SEQ ID NO: 212791 - protein, 15 aa, Borrelia garinii
GVRVLFPSYSQSSAM

SEQ ID NO: 212792 - protein, 15 aa, Borrelia garinii
VRVLFPSYSQSSAMI

SEQ ID NO: 212793 - protein, 15 aa, Borrelia garinii
RVLFPSYSQSSAMIM

SEQ ID NO: 212794 - protein, 15 aa, Borrelia garinii
VLFPSYSQSSAMIMP

SEQ ID NO: 212795 - protein, 15 aa, Borrelia garinii
LFPSYSQSSAMIMPP

SEQ ID NO: 212796 - protein, 15 aa, Borrelia garinii
FPSYSQSSAMIMPPF

SEQ ID NO: 212797 - protein, 15 aa, Borrelia garinii
PSYSQSSAMIMPPFK

SEQ ID NO: 212798 - protein, 15 aa, Borrelia garinii
SYSQSSAMIMPPFKI

SEQ ID NO: 212799 - protein, 15 aa, Borrelia garinii
YSQSSAMIMPPFKIP

SEQ ID NO: 212800 - protein, 15 aa, Borrelia garinii
SQSSAMIMPPFKIPF

SEQ ID NO: 212801 - protein, 15 aa, Borrelia garinii
QSSAMIMPPFKIPFY

SEQ ID NO: 212802 - protein, 15 aa, Borrelia garinii
SSAMIMPPFKIPFYS

SEQ ID NO: 212803 - protein, 15 aa, Borrelia garinii
SAMIMPPFKIPFYSG

SEQ ID NO: 212804 - protein, 15 aa, Borrelia garinii
AMIMPPFKIPFYSGE

SEQ ID NO: 212805 - protein, 15 aa, Borrelia garinii
MIMPPFKIPFYSGEN

SEQ ID NO: 212806 - protein, 15 aa, Borrelia garinii
IMPPFKIPFYSGENG

SEQ ID NO: 212807 - protein, 15 aa, Borrelia garinii
MPPFKIPFYSGENGN

SEQ ID NO: 212808 - protein, 15 aa, Borrelia garinii
PPFKIPFYSGENGNQ

SEQ ID NO: 212809 - protein, 15 aa, Borrelia garinii
PFKIPFYSGENGNQF

SEQ ID NO: 212810 - protein, 15 aa, Borrelia garinii
FKIPFYSGENGNQFL

SEQ ID NO: 212811 - protein, 15 aa, Borrelia garinii
KIPFYSGENGNQFLG

SEQ ID NO: 212812 - protein, 15 aa, Borrelia garinii
IPFYSGENGNQFLGK

SEQ ID NO: 212813 - protein, 15 aa, Borrelia garinii
PFYSGENGNQFLGKG

SEQ ID NO: 212814 - protein, 15 aa, Borrelia garinii
FYSGENGNQFLGKGL

SEQ ID NO: 212815 - protein, 15 aa, Borrelia garinii
YSGENGNQFLGKGLI

SEQ ID NO: 212816 - protein, 15 aa, Borrelia garinii
SGENGNQFLGKGLIN

SEQ ID NO: 212817 - protein, 15 aa, Borrelia garinii
GENGNQFLGKGLINN

SEQ ID NO: 212818 - protein, 15 aa, Borrelia garinii
ENGNQFLGKGLINNI

SEQ ID NO: 212819 - protein, 15 aa, Borrelia garinii
NGNQFLGKGLINNIK

SEQ ID NO: 212820 - protein, 15 aa, Borrelia garinii
GNQFLGKGLINNIKT

SEQ ID NO: 212821 - protein, 15 aa, Borrelia garinii
NQFLGKGLINNIKTM

SEQ ID NO: 212822 - protein, 15 aa, Borrelia garinii
QFLGKGLINNIKTMK

SEQ ID NO: 212823 - protein, 15 aa, Borrelia garinii
FLGKGLINNIKTMKE

SEQ ID NO: 212824 - protein, 15 aa, Borrelia garinii
LGKGLINNIKTMKEI

SEQ ID NO: 212825 - protein, 15 aa, Borrelia garinii
GKGLINNIKTMKEIK

SEQ ID NO: 212826 - protein, 15 aa, Borrelia garinii
KGLINNIKTMKEIKV

SEQ ID NO: 212827 - protein, 15 aa, Borrelia garinii
GLINNIKTMKEIKVS

SEQ ID NO: 212828 - protein, 15 aa, Borrelia garinii
LINNIKTMKEIKVSV

SEQ ID NO: 212829 - protein, 15 aa, Borrelia garinii
INNIKTMKEIKVSVY

SEQ ID NO: 212830 - protein, 15 aa, Borrelia garinii
NNIKTMKEIKVSVYS

SEQ ID NO: 212831 - protein, 15 aa, Borrelia garinii
NIKTMKEIKVSVYSL

SEQ ID NO: 212832 - protein, 15 aa, Borrelia garinii
IKTMKEIKVSVYSLG

SEQ ID NO: 212833 - protein, 15 aa, Borrelia garinii
KTMKEIKVSVYSLGY

SEQ ID NO: 212834 - protein, 15 aa, Borrelia garinii
TMKEIKVSVYSLGYE

SEQ ID NO: 212835 - protein, 15 aa, Borrelia garinii
MKEIKVSVYSLGYEI

SEQ ID NO: 212836 - protein, 15 aa, Borrelia garinii
KEIKVSVYSLGYEID

SEQ ID NO: 212837 - protein, 15 aa, Borrelia garinii
EIKVSVYSLGYEIDL

SEQ ID NO: 212838 - protein, 15 aa, Borrelia garinii
IKVSVYSLGYEIDLE

SEQ ID NO: 212839 - protein, 15 aa, Borrelia garinii
KVSVYSLGYEIDLEV

SEQ ID NO: 212840 - protein, 15 aa, Borrelia garinii
VSVYSLGYEIDLEVL

SEQ ID NO: 212841 - protein, 15 aa, Borrelia garinii
SVYSLGYEIDLEVLF

SEQ ID NO: 212842 - protein, 15 aa, Borrelia garinii
VYSLGYEIDLEVLFE

SEQ ID NO: 212843 - protein, 15 aa, Borrelia garinii
YSLGYEIDLEVLFED

SEQ ID NO: 212844 - protein, 15 aa, Borrelia garinii
SLGYEIDLEVLFEDM

SEQ ID NO: 212845 - protein, 15 aa, Borrelia garinii
LGYEIDLEVLFEDMN

SEQ ID NO: 212846 - protein, 15 aa, Borrelia garinii
GYEIDLEVLFEDMNG

SEQ ID NO: 212847 - protein, 15 aa, Borrelia garinii
YEIDLEVLFEDMNGM

SEQ ID NO: 212848 - protein, 15 aa, Borrelia garinii
EIDLEVLFEDMNGME

SEQ ID NO: 212849 - protein, 15 aa, Borrelia garinii
IDLEVLFEDMNGMEY

SEQ ID NO: 212850 - protein, 15 aa, Borrelia garinii
DLEVLFEDMNGMEYA

SEQ ID NO: 212851 - protein, 15 aa, Borrelia garinii
LEVLFEDMNGMEYAY

SEQ ID NO: 212852 - protein, 15 aa, Borrelia garinii
EVLFEDMNGMEYAYS

SEQ ID NO: 212853 - protein, 15 aa, Borrelia garinii
VLFEDMNGMEYAYSL

SEQ ID NO: 212854 - protein, 15 aa, Borrelia garinii
LFEDMNGMEYAYSLG

SEQ ID NO: 212855 - protein, 15 aa, Borrelia garinii
FEDMNGMEYAYSLGT

SEQ ID NO: 212856 - protein, 15 aa, Borrelia garinii
EDMNGMEYAYSLGTL

SEQ ID NO: 212857 - protein, 15 aa, Borrelia garinii
DMNGMEYAYSLGTLK

SEQ ID NO: 212858 - protein, 15 aa, Borrelia garinii
MNGMEYAYSLGTLKF

SEQ ID NO: 212859 - protein, 15 aa, Borrelia garinii
NGMEYAYSLGTLKFK

SEQ ID NO: 212860 - protein, 15 aa, Borrelia garinii
GMEYAYSLGTLKFKG

SEQ ID NO: 212861 - protein, 15 aa, Borrelia garinii
MEYAYSLGTLKFKGW

SEQ ID NO: 212862 - protein, 15 aa, Borrelia garinii
EYAYSLGTLKFKGWA

SEQ ID NO: 212863 - protein, 15 aa, Borrelia garinii
YAYSLGTLKFKGWAD

SEQ ID NO: 212864 - protein, 15 aa, Borrelia garinii
AYSLGTLKFKGWADL

SEQ ID NO: 212865 - protein, 15 aa, Borrelia garinii
YSLGTLKFKGWADLI

SEQ ID NO: 212866 - protein, 15 aa, Borrelia garinii
SLGTLKFKGWADLIW

SEQ ID NO: 212867 - protein, 15 aa, Borrelia garinii
LGTLKFKGWADLIWS

SEQ ID NO: 212868 - protein, 15 aa, Borrelia garinii
GTLKFKGWADLIWSN

SEQ ID NO: 212869 - protein, 15 aa, Borrelia garinii
TLKFKGWADLIWSNP

SEQ ID NO: 212870 - protein, 15 aa, Borrelia garinii
LKFKGWADLIWSNPN

SEQ ID NO: 212871 - protein, 15 aa, Borrelia garinii
KFKGWADLIWSNPNY

SEQ ID NO: 212872 - protein, 15 aa, Borrelia garinii
FKGWADLIWSNPNYI

SEQ ID NO: 212873 - protein, 15 aa, Borrelia garinii
KGWADLIWSNPNYIP

SEQ ID NO: 212874 - protein, 15 aa, Borrelia garinii
GWADLIWSNPNYIPN

SEQ ID NO: 212875 - protein, 15 aa, Borrelia garinii
WADLIWSNPNYIPNI

SEQ ID NO: 212876 - protein, 15 aa, Borrelia garinii
ADLIWSNPNYIPNIS

SEQ ID NO: 212877 - protein, 15 aa, Borrelia garinii
DLIWSNPNYIPNISS

SEQ ID NO: 212878 - protein, 15 aa, Borrelia garinii
LIWSNPNYIPNISSR

SEQ ID NO: 212879 - protein, 15 aa, Borrelia garinii
IWSNPNYIPNISSRI

SEQ ID NO: 212880 - protein, 15 aa, Borrelia garinii
WSNPNYIPNISSRII

SEQ ID NO: 212881 - protein, 15 aa, Borrelia garinii
SNPNYIPNISSRIIK

SEQ ID NO: 212882 - protein, 15 aa, Borrelia garinii
NPNYIPNISSRIIKD

SEQ ID NO: 212883 - protein, 15 aa, Borrelia garinii
PNYIPNISSRIIKDD

SEQ ID NO: 212884 - protein, 15 aa, Borrelia garinii
NYIPNISSRIIKDDV

SEQ ID NO: 212885 - protein, 15 aa, Borrelia garinii
YIPNISSRIIKDDVP

SEQ ID NO: 212886 - protein, 15 aa, Borrelia garinii
IPNISSRIIKDDVPN

SEQ ID NO: 212887 - protein, 15 aa, Borrelia garinii
PNISSRIIKDDVPNY

SEQ ID NO: 212888 - protein, 15 aa, Borrelia garinii
NISSRIIKDDVPNYP

SEQ ID NO: 212889 - protein, 15 aa, Borrelia garinii
ISSRIIKDDVPNYPL

SEQ ID NO: 212890 - protein, 15 aa, Borrelia garinii
SSRIIKDDVPNYPLA

SEQ ID NO: 212891 - protein, 15 aa, Borrelia garinii
SRIIKDDVPNYPLAS

SEQ ID NO: 212892 - protein, 15 aa, Borrelia garinii
RIIKDDVPNYPLASS

SEQ ID NO: 212893 - protein, 15 aa, Borrelia garinii
IIKDDVPNYPLASSK

SEQ ID NO: 212894 - protein, 15 aa, Borrelia garinii
IKDDVPNYPLASSKM

SEQ ID NO: 212895 - protein, 15 aa, Borrelia garinii
KDDVPNYPLASSKMR

SEQ ID NO: 212896 - protein, 15 aa, Borrelia garinii
DDVPNYPLASSKMRF

SEQ ID NO: 212897 - protein, 15 aa, Borrelia garinii
DVPNYPLASSKMRFK

SEQ ID NO: 212898 - protein, 15 aa, Borrelia garinii
VPNYPLASSKMRFKA

SEQ ID NO: 212899 - protein, 15 aa, Borrelia garinii
PNYPLASSKMRFKAF

SEQ ID NO: 212900 - protein, 15 aa, Borrelia garinii
NYPLASSKMRFKAFR

SEQ ID NO: 212901 - protein, 15 aa, Borrelia garinii
YPLASSKMRFKAFRV

SEQ ID NO: 212902 - protein, 15 aa, Borrelia garinii
PLASSKMRFKAFRVS

SEQ ID NO: 212903 - protein, 15 aa, Borrelia garinii
LASSKMRFKAFRVSK

SEQ ID NO: 212904 - protein, 15 aa, Borrelia garinii
ASSKMRFKAFRVSKS

SEQ ID NO: 212905 - protein, 15 aa, Borrelia garinii
SSKMRFKAFRVSKSH

SEQ ID NO: 212906 - protein, 15 aa, Borrelia garinii
SKMRFKAFRVSKSHS

SEQ ID NO: 212907 - protein, 15 aa, Borrelia garinii
KMRFKAFRVSKSHSS

SEQ ID NO: 212908 - protein, 15 aa, Borrelia garinii
MRFKAFRVSKSHSSK

SEQ ID NO: 212909 - protein, 15 aa, Borrelia garinii
RFKAFRVSKSHSSKE

SEQ ID NO: 212910 - protein, 15 aa, Borrelia garinii
FKAFRVSKSHSSKEQ

SEQ ID NO: 212911 - protein, 15 aa, Borrelia garinii
KAFRVSKSHSSKEQN

SEQ ID NO: 212912 - protein, 15 aa, Borrelia garinii
AFRVSKSHSSKEQNF

SEQ ID NO: 212913 - protein, 15 aa, Borrelia garinii
FRVSKSHSSKEQNFI

SEQ ID NO: 212914 - protein, 15 aa, Borrelia garinii
RVSKSHSSKEQNFIF

SEQ ID NO: 212915 - protein, 15 aa, Borrelia garinii
VSKSHSSKEQNFIFY

SEQ ID NO: 212916 - protein, 15 aa, Borrelia garinii
SKSHSSKEQNFIFYV

SEQ ID NO: 212917 - protein, 15 aa, Borrelia garinii
KSHSSKEQNFIFYVK

SEQ ID NO: 212918 - protein, 15 aa, Borrelia garinii
SHSSKEQNFIFYVKD

SEQ ID NO: 212919 - protein, 15 aa, Borrelia garinii
HSSKEQNFIFYVKDL

SEQ ID NO: 212920 - protein, 15 aa, Borrelia garinii
SSKEQNFIFYVKDLR

SEQ ID NO: 212921 - protein, 15 aa, Borrelia garinii
SKEQNFIFYVKDLRV

SEQ ID NO: 212922 - protein, 15 aa, Borrelia garinii
KEQNFIFYVKDLRVL

SEQ ID NO: 212923 - protein, 15 aa, Borrelia garinii
EQNFIFYVKDLRVLY

SEQ ID NO: 212924 - protein, 15 aa, Borrelia garinii
QNFIFYVKDLRVLYD

SEQ ID NO: 212925 - protein, 15 aa, Borrelia garinii
NFIFYVKDLRVLYDK

SEQ ID NO: 212926 - protein, 15 aa, Borrelia garinii
FIFYVKDLRVLYDKL

SEQ ID NO: 212927 - protein, 15 aa, Borrelia garinii
IFYVKDLRVLYDKLS

SEQ ID NO: 212928 - protein, 15 aa, Borrelia garinii
FYVKDLRVLYDKLSV

SEQ ID NO: 212929 - protein, 15 aa, Borrelia garinii
YVKDLRVLYDKLSVS

SEQ ID NO: 212930 - protein, 15 aa, Borrelia garinii
VKDLRVLYDKLSVSI

SEQ ID NO: 212931 - protein, 15 aa, Borrelia garinii
KDLRVLYDKLSVSID

SEQ ID NO: 212932 - protein, 15 aa, Borrelia garinii
DLRVLYDKLSVSIDS

SEQ ID NO: 212933 - protein, 15 aa, Borrelia garinii
LRVLYDKLSVSIDSD

SEQ ID NO: 212934 - protein, 15 aa, Borrelia garinii
RVLYDKLSVSIDSDI

SEQ ID NO: 212935 - protein, 15 aa, Borrelia garinii
VLYDKLSVSIDSDID

SEQ ID NO: 212936 - protein, 15 aa, Borrelia garinii
LYDKLSVSIDSDIDS

SEQ ID NO: 212937 - protein, 15 aa, Borrelia garinii
YDKLSVSIDSDIDSE

SEQ ID NO: 212938 - protein, 15 aa, Borrelia garinii
DKLSVSIDSDIDSES

SEQ ID NO: 212939 - protein, 15 aa, Borrelia garinii
KLSVSIDSDIDSESV

SEQ ID NO: 212940 - protein, 15 aa, Borrelia garinii
LSVSIDSDIDSESVF

SEQ ID NO: 212941 - protein, 15 aa, Borrelia garinii
SVSIDSDIDSESVFK

SEQ ID NO: 212942 - protein, 15 aa, Borrelia garinii
VSIDSDIDSESVFKV

SEQ ID NO: 212943 - protein, 15 aa, Borrelia garinii
SIDSDIDSESVFKVY

SEQ ID NO: 212944 - protein, 15 aa, Borrelia garinii
IDSDIDSESVFKVYE

SEQ ID NO: 212945 - protein, 15 aa, Borrelia garinii
DSDIDSESVFKVYET

SEQ ID NO: 212946 - protein, 15 aa, Borrelia garinii
SDIDSESVFKVYETS

SEQ ID NO: 212947 - protein, 15 aa, Borrelia garinii
DIDSESVFKVYETSG

SEQ ID NO: 212948 - protein, 15 aa, Borrelia garinii
IDSESVFKVYETSGT

SEQ ID NO: 212949 - protein, 15 aa, Borrelia garinii
DSESVFKVYETSGTE

SEQ ID NO: 212950 - protein, 15 aa, Borrelia garinii
SESVFKVYETSGTES

SEQ ID NO: 212951 - protein, 15 aa, Borrelia garinii
ESVFKVYETSGTESL

SEQ ID NO: 212952 - protein, 15 aa, Borrelia garinii
SVFKVYETSGTESLR

SEQ ID NO: 212953 - protein, 15 aa, Borrelia garinii
VFKVYETSGTESLRK

SEQ ID NO: 212954 - protein, 15 aa, Borrelia garinii
FKVYETSGTESLRKL

SEQ ID NO: 212955 - protein, 15 aa, Borrelia garinii
KVYETSGTESLRKLK

SEQ ID NO: 212956 - protein, 15 aa, Borrelia garinii
VYETSGTESLRKLKA

SEQ ID NO: 212957 - protein, 15 aa, Borrelia garinii
YETSGTESLRKLKAH

SEQ ID NO: 212958 - protein, 15 aa, Borrelia garinii
ETSGTESLRKLKAHE

SEQ ID NO: 212959 - protein, 15 aa, Borrelia garinii
TSGTESLRKLKAHET

SEQ ID NO: 212960 - protein, 15 aa, Borrelia garinii
SGTESLRKLKAHETF

SEQ ID NO: 212961 - protein, 15 aa, Borrelia garinii
GTESLRKLKAHETFK

SEQ ID NO: 212962 - protein, 15 aa, Borrelia garinii
TESLRKLKAHETFKR

SEQ ID NO: 212963 - protein, 15 aa, Borrelia garinii
ESLRKLKAHETFKRV

SEQ ID NO: 212964 - protein, 15 aa, Borrelia garinii
SLRKLKAHETFKRVL

SEQ ID NO: 212965 - protein, 15 aa, Borrelia garinii
LRKLKAHETFKRVLK

SEQ ID NO: 212966 - protein, 15 aa, Borrelia garinii
RKLKAHETFKRVLKL

SEQ ID NO: 212967 - protein, 15 aa, Borrelia garinii
KLKAHETFKRVLKLR

SEQ ID NO: 212968 - protein, 15 aa, Borrelia garinii
LKAHETFKRVLKLRE

SEQ ID NO: 212969 - protein, 15 aa, Borrelia garinii
KAHETFKRVLKLREK

SEQ ID NO: 212970 - protein, 15 aa, Borrelia garinii
AHETFKRVLKLREKI

SEQ ID NO: 212971 - protein, 15 aa, Borrelia garinii
HETFKRVLKLREKIS

SEQ ID NO: 212972 - protein, 15 aa, Borrelia garinii
ETFKRVLKLREKISM

SEQ ID NO: 212973 - protein, 15 aa, Borrelia garinii
TFKRVLKLREKISMP

SEQ ID NO: 212974 - protein, 15 aa, Borrelia garinii
FKRVLKLREKISMPE

SEQ ID NO: 212975 - protein, 15 aa, Borrelia garinii
KRVLKLREKISMPEG

SEQ ID NO: 212976 - protein, 15 aa, Borrelia garinii
RVLKLREKISMPEGS

SEQ ID NO: 212977 - protein, 15 aa, Borrelia garinii
VLKLREKISMPEGSF

SEQ ID NO: 212978 - protein, 15 aa, Borrelia garinii
LKLREKISMPEGSFQ

SEQ ID NO: 212979 - protein, 15 aa, Borrelia garinii
KLREKISMPEGSFQN

SEQ ID NO: 212980 - protein, 15 aa, Borrelia garinii
LREKISMPEGSFQNF

SEQ ID NO: 212981 - protein, 15 aa, Borrelia garinii
REKISMPEGSFQNFI

SEQ ID NO: 212982 - protein, 15 aa, Borrelia garinii
EKISMPEGSFQNFIE

SEQ ID NO: 212983 - protein, 15 aa, Borrelia garinii
KISMPEGSFQNFIEK

SEQ ID NO: 212984 - protein, 15 aa, Borrelia garinii
ISMPEGSFQNFIEKV

SEQ ID NO: 212985 - protein, 15 aa, Borrelia garinii
SMPEGSFQNFIEKVE

SEQ ID NO: 212986 - protein, 15 aa, Borrelia garinii
MPEGSFQNFIEKVES

SEQ ID NO: 212987 - protein, 15 aa, Borrelia garinii
PEGSFQNFIEKVESE

SEQ ID NO: 212988 - protein, 15 aa, Borrelia garinii
EGSFQNFIEKVESEK

SEQ ID NO: 212989 - protein, 15 aa, Borrelia garinii
GSFQNFIEKVESEKK

SEQ ID NO: 212990 - protein, 15 aa, Borrelia garinii
SFQNFIEKVESEKKP

SEQ ID NO: 212991 - protein, 15 aa, Borrelia garinii
FQNFIEKVESEKKPE

SEQ ID NO: 212992 - protein, 15 aa, Borrelia garinii
QNFIEKVESEKKPEE

SEQ ID NO: 212993 - protein, 15 aa, Borrelia garinii
NFIEKVESEKKPEES

SEQ ID NO: 212994 - protein, 15 aa, Borrelia garinii
FIEKVESEKKPEESS

SEQ ID NO: 212995 - protein, 15 aa, Borrelia garinii
IEKVESEKKPEESSL

SEQ ID NO: 212996 - protein, 15 aa, Borrelia garinii
EKVESEKKPEESSLK

SEQ ID NO: 212997 - protein, 15 aa, Borrelia garinii
KVESEKKPEESSLKK

SEQ ID NO: 212998 - protein, 16 aa, Borrelia garinii
MKRKAKSILLFLLSTA

SEQ ID NO: 212999 - protein, 16 aa, Borrelia garinii
KRKAKSILLFLLSTAL

SEQ ID NO: 213000 - protein, 16 aa, Borrelia garinii
RKAKSILLFLLSTALF

SEQ ID NO: 213001 - protein, 16 aa, Borrelia garinii
KAKSILLFLLSTALFA

SEQ ID NO: 213002 - protein, 16 aa, Borrelia garinii
AKSILLFLLSTALFAQ

SEQ ID NO: 213003 - protein, 16 aa, Borrelia garinii
KSILLFLLSTALFAQE

SEQ ID NO: 213004 - protein, 16 aa, Borrelia garinii
SILLFLLSTALFAQET

SEQ ID NO: 213005 - protein, 16 aa, Borrelia garinii
ILLFLLSTALFAQETD

SEQ ID NO: 213006 - protein, 16 aa, Borrelia garinii
LLFLLSTALFAQETDG

SEQ ID NO: 213007 - protein, 16 aa, Borrelia garinii
LFLLSTALFAQETDGL

SEQ ID NO: 213008 - protein, 16 aa, Borrelia garinii
FLLSTALFAQETDGLP

SEQ ID NO: 213009 - protein, 16 aa, Borrelia garinii
LLSTALFAQETDGLPE

SEQ ID NO: 213010 - protein, 16 aa, Borrelia garinii
LSTALFAQETDGLPEG

SEQ ID NO: 213011 - protein, 16 aa, Borrelia garinii
STALFAQETDGLPEGS

SEQ ID NO: 213012 - protein, 16 aa, Borrelia garinii
TALFAQETDGLPEGSK

SEQ ID NO: 213013 - protein, 16 aa, Borrelia garinii
ALFAQETDGLPEGSKR

SEQ ID NO: 213014 - protein, 16 aa, Borrelia garinii
LFAQETDGLPEGSKRS

SEQ ID NO: 213015 - protein, 16 aa, Borrelia garinii
FAQETDGLPEGSKRSE

SEQ ID NO: 213016 - protein, 16 aa, Borrelia garinii
AQETDGLPEGSKRSEP

SEQ ID NO: 213017 - protein, 16 aa, Borrelia garinii
QETDGLPEGSKRSEPG

SEQ ID NO: 213018 - protein, 16 aa, Borrelia garinii
ETDGLPEGSKRSEPGE

SEQ ID NO: 213019 - protein, 16 aa, Borrelia garinii
TDGLPEGSKRSEPGEL

SEQ ID NO: 213020 - protein, 16 aa, Borrelia garinii
DGLPEGSKRSEPGELV

SEQ ID NO: 213021 - protein, 16 aa, Borrelia garinii
GLPEGSKRSEPGELVL

SEQ ID NO: 213022 - protein, 16 aa, Borrelia garinii
LPEGSKRSEPGELVLD

SEQ ID NO: 213023 - protein, 16 aa, Borrelia garinii
PEGSKRSEPGELVLDF

SEQ ID NO: 213024 - protein, 16 aa, Borrelia garinii
EGSKRSEPGELVLDFA

SEQ ID NO: 213025 - protein, 16 aa, Borrelia garinii
GSKRSEPGELVLDFAE

SEQ ID NO: 213026 - protein, 16 aa, Borrelia garinii
SKRSEPGELVLDFAEL

SEQ ID NO: 213027 - protein, 16 aa, Borrelia garinii
KRSEPGELVLDFAELA

SEQ ID NO: 213028 - protein, 16 aa, Borrelia garinii
RSEPGELVLDFAELAR

SEQ ID NO: 213029 - protein, 16 aa, Borrelia garinii
SEPGELVLDFAELARD

SEQ ID NO: 213030 - protein, 16 aa, Borrelia garinii
EPGELVLDFAELARDP

SEQ ID NO: 213031 - protein, 16 aa, Borrelia garinii
PGELVLDFAELARDPS

SEQ ID NO: 213032 - protein, 16 aa, Borrelia garinii
GELVLDFAELARDPSS

SEQ ID NO: 213033 - protein, 16 aa, Borrelia garinii
ELVLDFAELARDPSST

SEQ ID NO: 213034 - protein, 16 aa, Borrelia garinii
LVLDFAELARDPSSTK

SEQ ID NO: 213035 - protein, 16 aa, Borrelia garinii
VLDFAELARDPSSTKL

SEQ ID NO: 213036 - protein, 16 aa, Borrelia garinii
LDFAELARDPSSTKLD

SEQ ID NO: 213037 - protein, 16 aa, Borrelia garinii
DFAELARDPSSTKLDL

SEQ ID NO: 213038 - protein, 16 aa, Borrelia garinii
FAELARDPSSTKLDLT

SEQ ID NO: 213039 - protein, 16 aa, Borrelia garinii
AELARDPSSTKLDLTN

SEQ ID NO: 213040 - protein, 16 aa, Borrelia garinii
ELARDPSSTKLDLTNY

SEQ ID NO: 213041 - protein, 16 aa, Borrelia garinii
LARDPSSTKLDLTNYV

SEQ ID NO: 213042 - protein, 16 aa, Borrelia garinii
ARDPSSTKLDLTNYVD

SEQ ID NO: 213043 - protein, 16 aa, Borrelia garinii
RDPSSTKLDLTNYVDY

SEQ ID NO: 213044 - protein, 16 aa, Borrelia garinii
DPSSTKLDLTNYVDYV

SEQ ID NO: 213045 - protein, 16 aa, Borrelia garinii
PSSTKLDLTNYVDYVY

SEQ ID NO: 213046 - protein, 16 aa, Borrelia garinii
SSTKLDLTNYVDYVYS

SEQ ID NO: 213047 - protein, 16 aa, Borrelia garinii
STKLDLTNYVDYVYSG

SEQ ID NO: 213048 - protein, 16 aa, Borrelia garinii
TKLDLTNYVDYVYSGA

SEQ ID NO: 213049 - protein, 16 aa, Borrelia garinii
KLDLTNYVDYVYSGAS

SEQ ID NO: 213050 - protein, 16 aa, Borrelia garinii
LDLTNYVDYVYSGASG

SEQ ID NO: 213051 - protein, 16 aa, Borrelia garinii
DLTNYVDYVYSGASGI

SEQ ID NO: 213052 - protein, 16 aa, Borrelia garinii
LTNYVDYVYSGASGIV

SEQ ID NO: 213053 - protein, 16 aa, Borrelia garinii
TNYVDYVYSGASGIVK

SEQ ID NO: 213054 - protein, 16 aa, Borrelia garinii
NYVDYVYSGASGIVKP

SEQ ID NO: 213055 - protein, 16 aa, Borrelia garinii
YVDYVYSGASGIVKPE

SEQ ID NO: 213056 - protein, 16 aa, Borrelia garinii
VDYVYSGASGIVKPED

SEQ ID NO: 213057 - protein, 16 aa, Borrelia garinii
DYVYSGASGIVKPEDM

SEQ ID NO: 213058 - protein, 16 aa, Borrelia garinii
YVYSGASGIVKPEDMV

SEQ ID NO: 213059 - protein, 16 aa, Borrelia garinii
VYSGASGIVKPEDMVV

SEQ ID NO: 213060 - protein, 16 aa, Borrelia garinii
YSGASGIVKPEDMVVD

SEQ ID NO: 213061 - protein, 16 aa, Borrelia garinii
SGASGIVKPEDMVVDL

SEQ ID NO: 213062 - protein, 16 aa, Borrelia garinii
GASGIVKPEDMVVDLG

SEQ ID NO: 213063 - protein, 16 aa, Borrelia garinii
ASGIVKPEDMVVDLGI

SEQ ID NO: 213064 - protein, 16 aa, Borrelia garinii
SGIVKPEDMVVDLGIN

SEQ ID NO: 213065 - protein, 16 aa, Borrelia garinii
GIVKPEDMVVDLGINN

SEQ ID NO: 213066 - protein, 16 aa, Borrelia garinii
IVKPEDMVVDLGINNW

SEQ ID NO: 213067 - protein, 16 aa, Borrelia garinii
VKPEDMVVDLGINNWS

SEQ ID NO: 213068 - protein, 16 aa, Borrelia garinii
KPEDMVVDLGINNWSV

SEQ ID NO: 213069 - protein, 16 aa, Borrelia garinii
PEDMVVDLGINNWSVL

SEQ ID NO: 213070 - protein, 16 aa, Borrelia garinii
EDMVVDLGINNWSVLL

SEQ ID NO: 213071 - protein, 16 aa, Borrelia garinii
DMVVDLGINNWSVLLT

SEQ ID NO: 213072 - protein, 16 aa, Borrelia garinii
MVVDLGINNWSVLLTP

SEQ ID NO: 213073 - protein, 16 aa, Borrelia garinii
VVDLGINNWSVLLTPS

SEQ ID NO: 213074 - protein, 16 aa, Borrelia garinii
VDLGINNWSVLLTPSA

SEQ ID NO: 213075 - protein, 16 aa, Borrelia garinii
DLGINNWSVLLTPSAR

SEQ ID NO: 213076 - protein, 16 aa, Borrelia garinii
LGINNWSVLLTPSARL

SEQ ID NO: 213077 - protein, 16 aa, Borrelia garinii
GINNWSVLLTPSARLQ

SEQ ID NO: 213078 - protein, 16 aa, Borrelia garinii
INNWSVLLTPSARLQA

SEQ ID NO: 213079 - protein, 16 aa, Borrelia garinii
NNWSVLLTPSARLQAY

SEQ ID NO: 213080 - protein, 16 aa, Borrelia garinii
NWSVLLTPSARLQAYV

SEQ ID NO: 213081 - protein, 16 aa, Borrelia garinii
WSVLLTPSARLQAYVK

SEQ ID NO: 213082 - protein, 16 aa, Borrelia garinii
SVLLTPSARLQAYVKN

SEQ ID NO: 213083 - protein, 16 aa, Borrelia garinii
VLLTPSARLQAYVKNS

SEQ ID NO: 213084 - protein, 16 aa, Borrelia garinii
LLTPSARLQAYVKNSV

SEQ ID NO: 213085 - protein, 16 aa, Borrelia garinii
LTPSARLQAYVKNSVV

SEQ ID NO: 213086 - protein, 16 aa, Borrelia garinii
TPSARLQAYVKNSVVA

SEQ ID NO: 213087 - protein, 16 aa, Borrelia garinii
PSARLQAYVKNSVVAP

SEQ ID NO: 213088 - protein, 16 aa, Borrelia garinii
SARLQAYVKNSVVAPA

SEQ ID NO: 213089 - protein, 16 aa, Borrelia garinii
ARLQAYVKNSVVAPAV

SEQ ID NO: 213090 - protein, 16 aa, Borrelia garinii
RLQAYVKNSVVAPAVV

SEQ ID NO: 213091 - protein, 16 aa, Borrelia garinii
LQAYVKNSVVAPAVVK

SEQ ID NO: 213092 - protein, 16 aa, Borrelia garinii
QAYVKNSVVAPAVVKS

SEQ ID NO: 213093 - protein, 16 aa, Borrelia garinii
AYVKNSVVAPAVVKSE

SEQ ID NO: 213094 - protein, 16 aa, Borrelia garinii
YVKNSVVAPAVVKSES

SEQ ID NO: 213095 - protein, 16 aa, Borrelia garinii
VKNSVVAPAVVKSESK

SEQ ID NO: 213096 - protein, 16 aa, Borrelia garinii
KNSVVAPAVVKSESKR

SEQ ID NO: 213097 - protein, 16 aa, Borrelia garinii
NSVVAPAVVKSESKRY

SEQ ID NO: 213098 - protein, 16 aa, Borrelia garinii
SVVAPAVVKSESKRYA

SEQ ID NO: 213099 - protein, 16 aa, Borrelia garinii
VVAPAVVKSESKRYAG

SEQ ID NO: 213100 - protein, 16 aa, Borrelia garinii
VAPAVVKSESKRYAGD

SEQ ID NO: 213101 - protein, 16 aa, Borrelia garinii
APAVVKSESKRYAGDT

SEQ ID NO: 213102 - protein, 16 aa, Borrelia garinii
PAVVKSESKRYAGDTI

SEQ ID NO: 213103 - protein, 16 aa, Borrelia garinii
AVVKSESKRYAGDTIL

SEQ ID NO: 213104 - protein, 16 aa, Borrelia garinii
VVKSESKRYAGDTILG

SEQ ID NO: 213105 - protein, 16 aa, Borrelia garinii
VKSESKRYAGDTILGV

SEQ ID NO: 213106 - protein, 16 aa, Borrelia garinii
KSESKRYAGDTILGVR

SEQ ID NO: 213107 - protein, 16 aa, Borrelia garinii
SESKRYAGDTILGVRV

SEQ ID NO: 213108 - protein, 16 aa, Borrelia garinii
ESKRYAGDTILGVRVL

SEQ ID NO: 213109 - protein, 16 aa, Borrelia garinii
SKRYAGDTILGVRVLF

SEQ ID NO: 213110 - protein, 16 aa, Borrelia garinii
KRYAGDTILGVRVLFP

SEQ ID NO: 213111 - protein, 16 aa, Borrelia garinii
RYAGDTILGVRVLFPS

SEQ ID NO: 213112 - protein, 16 aa, Borrelia garinii
YAGDTILGVRVLFPSY

SEQ ID NO: 213113 - protein, 16 aa, Borrelia garinii
AGDTILGVRVLFPSYS

SEQ ID NO: 213114 - protein, 16 aa, Borrelia garinii
GDTILGVRVLFPSYSQ

SEQ ID NO: 213115 - protein, 16 aa, Borrelia garinii
DTILGVRVLFPSYSQS

SEQ ID NO: 213116 - protein, 16 aa, Borrelia garinii
TILGVRVLFPSYSQSS

SEQ ID NO: 213117 - protein, 16 aa, Borrelia garinii
ILGVRVLFPSYSQSSA

SEQ ID NO: 213118 - protein, 16 aa, Borrelia garinii
LGVRVLFPSYSQSSAM

SEQ ID NO: 213119 - protein, 16 aa, Borrelia garinii
GVRVLFPSYSQSSAMI

SEQ ID NO: 213120 - protein, 16 aa, Borrelia garinii
VRVLFPSYSQSSAMIM

SEQ ID NO: 213121 - protein, 16 aa, Borrelia garinii
RVLFPSYSQSSAMIMP

SEQ ID NO: 213122 - protein, 16 aa, Borrelia garinii
VLFPSYSQSSAMIMPP

SEQ ID NO: 213123 - protein, 16 aa, Borrelia garinii
LFPSYSQSSAMIMPPF

SEQ ID NO: 213124 - protein, 16 aa, Borrelia garinii
FPSYSQSSAMIMPPFK

SEQ ID NO: 213125 - protein, 16 aa, Borrelia garinii
PSYSQSSAMIMPPFKI

SEQ ID NO: 213126 - protein, 16 aa, Borrelia garinii
SYSQSSAMIMPPFKIP

SEQ ID NO: 213127 - protein, 16 aa, Borrelia garinii
YSQSSAMIMPPFKIPF

SEQ ID NO: 213128 - protein, 16 aa, Borrelia garinii
SQSSAMIMPPFKIPFY

SEQ ID NO: 213129 - protein, 16 aa, Borrelia garinii
QSSAMIMPPFKIPFYS

SEQ ID NO: 213130 - protein, 16 aa, Borrelia garinii
SSAMIMPPFKIPFYSG

SEQ ID NO: 213131 - protein, 16 aa, Borrelia garinii
SAMIMPPFKIPFYSGE

SEQ ID NO: 213132 - protein, 16 aa, Borrelia garinii
AMIMPPFKIPFYSGEN

SEQ ID NO: 213133 - protein, 16 aa, Borrelia garinii
MIMPPFKIPFYSGENG

SEQ ID NO: 213134 - protein, 16 aa, Borrelia garinii
IMPPFKIPFYSGENGN

SEQ ID NO: 213135 - protein, 16 aa, Borrelia garinii
MPPFKIPFYSGENGNQ

SEQ ID NO: 213136 - protein, 16 aa, Borrelia garinii
PPFKIPFYSGENGNQF

SEQ ID NO: 213137 - protein, 16 aa, Borrelia garinii
PFKIPFYSGENGNQFL

SEQ ID NO: 213138 - protein, 16 aa, Borrelia garinii
FKIPFYSGENGNQFLG

SEQ ID NO: 213139 - protein, 16 aa, Borrelia garinii
KIPFYSGENGNQFLGK

SEQ ID NO: 213140 - protein, 16 aa, Borrelia garinii
IPFYSGENGNQFLGKG

SEQ ID NO: 213141 - protein, 16 aa, Borrelia garinii
PFYSGENGNQFLGKGL

SEQ ID NO: 213142 - protein, 16 aa, Borrelia garinii
FYSGENGNQFLGKGLI

SEQ ID NO: 213143 - protein, 16 aa, Borrelia garinii
YSGENGNQFLGKGLIN

SEQ ID NO: 213144 - protein, 16 aa, Borrelia garinii
SGENGNQFLGKGLINN

SEQ ID NO: 213145 - protein, 16 aa, Borrelia garinii
GENGNQFLGKGLINNI

SEQ ID NO: 213146 - protein, 16 aa, Borrelia garinii
ENGNQFLGKGLINNIK

SEQ ID NO: 213147 - protein, 16 aa, Borrelia garinii
NGNQFLGKGLINNIKT

SEQ ID NO: 213148 - protein, 16 aa, Borrelia garinii
GNQFLGKGLINNIKTM

SEQ ID NO: 213149 - protein, 16 aa, Borrelia garinii
NQFLGKGLINNIKTMK

SEQ ID NO: 213150 - protein, 16 aa, Borrelia garinii
QFLGKGLINNIKTMKE

SEQ ID NO: 213151 - protein, 16 aa, Borrelia garinii
FLGKGLINNIKTMKEI

SEQ ID NO: 213152 - protein, 16 aa, Borrelia garinii
LGKGLINNIKTMKEIK

SEQ ID NO: 213153 - protein, 16 aa, Borrelia garinii
GKGLINNIKTMKEIKV

SEQ ID NO: 213154 - protein, 16 aa, Borrelia garinii
KGLINNIKTMKEIKVS

SEQ ID NO: 213155 - protein, 16 aa, Borrelia garinii
GLINNIKTMKEIKVSV

SEQ ID NO: 213156 - protein, 16 aa, Borrelia garinii
LINNIKTMKEIKVSVY

SEQ ID NO: 213157 - protein, 16 aa, Borrelia garinii
INNIKTMKEIKVSVYS

SEQ ID NO: 213158 - protein, 16 aa, Borrelia garinii
NNIKTMKEIKVSVYSL

SEQ ID NO: 213159 - protein, 16 aa, Borrelia garinii
NIKTMKEIKVSVYSLG

SEQ ID NO: 213160 - protein, 16 aa, Borrelia garinii
IKTMKEIKVSVYSLGY

SEQ ID NO: 213161 - protein, 16 aa, Borrelia garinii
KTMKEIKVSVYSLGYE

SEQ ID NO: 213162 - protein, 16 aa, Borrelia garinii
TMKEIKVSVYSLGYEI

SEQ ID NO: 213163 - protein, 16 aa, Borrelia garinii
MKEIKVSVYSLGYEID

SEQ ID NO: 213164 - protein, 16 aa, Borrelia garinii
KEIKVSVYSLGYEIDL

SEQ ID NO: 213165 - protein, 16 aa, Borrelia garinii
EIKVSVYSLGYEIDLE

SEQ ID NO: 213166 - protein, 16 aa, Borrelia garinii
IKVSVYSLGYEIDLEV

SEQ ID NO: 213167 - protein, 16 aa, Borrelia garinii
KVSVYSLGYEIDLEVL

SEQ ID NO: 213168 - protein, 16 aa, Borrelia garinii
VSVYSLGYEIDLEVLF

SEQ ID NO: 213169 - protein, 16 aa, Borrelia garinii
SVYSLGYEIDLEVLFE

SEQ ID NO: 213170 - protein, 16 aa, Borrelia garinii
VYSLGYEIDLEVLFED

SEQ ID NO: 213171 - protein, 16 aa, Borrelia garinii
YSLGYEIDLEVLFEDM

SEQ ID NO: 213172 - protein, 16 aa, Borrelia garinii
SLGYEIDLEVLFEDMN

SEQ ID NO: 213173 - protein, 16 aa, Borrelia garinii
LGYEIDLEVLFEDMNG

SEQ ID NO: 213174 - protein, 16 aa, Borrelia garinii
GYEIDLEVLFEDMNGM

SEQ ID NO: 213175 - protein, 16 aa, Borrelia garinii
YEIDLEVLFEDMNGME

SEQ ID NO: 213176 - protein, 16 aa, Borrelia garinii
EIDLEVLFEDMNGMEY

SEQ ID NO: 213177 - protein, 16 aa, Borrelia garinii
IDLEVLFEDMNGMEYA

SEQ ID NO: 213178 - protein, 16 aa, Borrelia garinii
DLEVLFEDMNGMEYAY

SEQ ID NO: 213179 - protein, 16 aa, Borrelia garinii
LEVLFEDMNGMEYAYS

SEQ ID NO: 213180 - protein, 16 aa, Borrelia garinii
EVLFEDMNGMEYAYSL

SEQ ID NO: 213181 - protein, 16 aa, Borrelia garinii
VLFEDMNGMEYAYSLG

SEQ ID NO: 213182 - protein, 16 aa, Borrelia garinii
LFEDMNGMEYAYSLGT

SEQ ID NO: 213183 - protein, 16 aa, Borrelia garinii
FEDMNGMEYAYSLGTL

SEQ ID NO: 213184 - protein, 16 aa, Borrelia garinii
EDMNGMEYAYSLGTLK

SEQ ID NO: 213185 - protein, 16 aa, Borrelia garinii
DMNGMEYAYSLGTLKF

SEQ ID NO: 213186 - protein, 16 aa, Borrelia garinii
MNGMEYAYSLGTLKFK

SEQ ID NO: 213187 - protein, 16 aa, Borrelia garinii
NGMEYAYSLGTLKFKG

SEQ ID NO: 213188 - protein, 16 aa, Borrelia garinii
GMEYAYSLGTLKFKGW

SEQ ID NO: 213189 - protein, 16 aa, Borrelia garinii
MEYAYSLGTLKFKGWA

SEQ ID NO: 213190 - protein, 16 aa, Borrelia garinii
EYAYSLGTLKFKGWAD

SEQ ID NO: 213191 - protein, 16 aa, Borrelia garinii
YAYSLGTLKFKGWADL

SEQ ID NO: 213192 - protein, 16 aa, Borrelia garinii
AYSLGTLKFKGWADLI

SEQ ID NO: 213193 - protein, 16 aa, Borrelia garinii
YSLGTLKFKGWADLIW

SEQ ID NO: 213194 - protein, 16 aa, Borrelia garinii
SLGTLKFKGWADLIWS

SEQ ID NO: 213195 - protein, 16 aa, Borrelia garinii
LGTLKFKGWADLIWSN

SEQ ID NO: 213196 - protein, 16 aa, Borrelia garinii
GTLKFKGWADLIWSNP

SEQ ID NO: 213197 - protein, 16 aa, Borrelia garinii
TLKFKGWADLIWSNPN

SEQ ID NO: 213198 - protein, 16 aa, Borrelia garinii
LKFKGWADLIWSNPNY

SEQ ID NO: 213199 - protein, 16 aa, Borrelia garinii
KFKGWADLIWSNPNYI

SEQ ID NO: 213200 - protein, 16 aa, Borrelia garinii
FKGWADLIWSNPNYIP

SEQ ID NO: 213201 - protein, 16 aa, Borrelia garinii
KGWADLIWSNPNYIPN

SEQ ID NO: 213202 - protein, 16 aa, Borrelia garinii
GWADLIWSNPNYIPNI

SEQ ID NO: 213203 - protein, 16 aa, Borrelia garinii
WADLIWSNPNYIPNIS

SEQ ID NO: 213204 - protein, 16 aa, Borrelia garinii
ADLIWSNPNYIPNISS

SEQ ID NO: 213205 - protein, 16 aa, Borrelia garinii
DLIWSNPNYIPNISSR

SEQ ID NO: 213206 - protein, 16 aa, Borrelia garinii
LIWSNPNYIPNISSRI

SEQ ID NO: 213207 - protein, 16 aa, Borrelia garinii
IWSNPNYIPNISSRII

SEQ ID NO: 213208 - protein, 16 aa, Borrelia garinii
WSNPNYIPNISSRIIK

SEQ ID NO: 213209 - protein, 16 aa, Borrelia garinii
SNPNYIPNISSRIIKD

SEQ ID NO: 213210 - protein, 16 aa, Borrelia garinii
NPNYIPNISSRIIKDD

SEQ ID NO: 213211 - protein, 16 aa, Borrelia garinii
PNYIPNISSRIIKDDV

SEQ ID NO: 213212 - protein, 16 aa, Borrelia garinii
NYIPNISSRIIKDDVP

SEQ ID NO: 213213 - protein, 16 aa, Borrelia garinii
YIPNISSRIIKDDVPN

SEQ ID NO: 213214 - protein, 16 aa, Borrelia garinii
IPNISSRIIKDDVPNY

SEQ ID NO: 213215 - protein, 16 aa, Borrelia garinii
PNISSRIIKDDVPNYP

SEQ ID NO: 213216 - protein, 16 aa, Borrelia garinii
NISSRIIKDDVPNYPL

SEQ ID NO: 213217 - protein, 16 aa, Borrelia garinii
ISSRIIKDDVPNYPLA

SEQ ID NO: 213218 - protein, 16 aa, Borrelia garinii
SSRIIKDDVPNYPLAS

SEQ ID NO: 213219 - protein, 16 aa, Borrelia garinii
SRIIKDDVPNYPLASS

SEQ ID NO: 213220 - protein, 16 aa, Borrelia garinii
RIIKDDVPNYPLASSK

SEQ ID NO: 213221 - protein, 16 aa, Borrelia garinii
IIKDDVPNYPLASSKM

SEQ ID NO: 213222 - protein, 16 aa, Borrelia garinii
IKDDVPNYPLASSKMR

SEQ ID NO: 213223 - protein, 16 aa, Borrelia garinii
KDDVPNYPLASSKMRF

SEQ ID NO: 213224 - protein, 16 aa, Borrelia garinii
DDVPNYPLASSKMRFK

SEQ ID NO: 213225 - protein, 16 aa, Borrelia garinii
DVPNYPLASSKMRFKA

SEQ ID NO: 213226 - protein, 16 aa, Borrelia garinii
VPNYPLASSKMRFKAF

SEQ ID NO: 213227 - protein, 16 aa, Borrelia garinii
PNYPLASSKMRFKAFR

SEQ ID NO: 213228 - protein, 16 aa, Borrelia garinii
NYPLASSKMRFKAFRV

SEQ ID NO: 213229 - protein, 16 aa, Borrelia garinii
YPLASSKMRFKAFRVS

SEQ ID NO: 213230 - protein, 16 aa, Borrelia garinii
PLASSKMRFKAFRVSK

SEQ ID NO: 213231 - protein, 16 aa, Borrelia garinii
LASSKMRFKAFRVSKS

SEQ ID NO: 213232 - protein, 16 aa, Borrelia garinii
ASSKMRFKAFRVSKSH

SEQ ID NO: 213233 - protein, 16 aa, Borrelia garinii
SSKMRFKAFRVSKSHS

SEQ ID NO: 213234 - protein, 16 aa, Borrelia garinii
SKMRFKAFRVSKSHSS

SEQ ID NO: 213235 - protein, 16 aa, Borrelia garinii
KMRFKAFRVSKSHSSK

SEQ ID NO: 213236 - protein, 16 aa, Borrelia garinii
MRFKAFRVSKSHSSKE

SEQ ID NO: 213237 - protein, 16 aa, Borrelia garinii
RFKAFRVSKSHSSKEQ

SEQ ID NO: 213238 - protein, 16 aa, Borrelia garinii
FKAFRVSKSHSSKEQN

SEQ ID NO: 213239 - protein, 16 aa, Borrelia garinii
KAFRVSKSHSSKEQNF

SEQ ID NO: 213240 - protein, 16 aa, Borrelia garinii
AFRVSKSHSSKEQNFI

SEQ ID NO: 213241 - protein, 16 aa, Borrelia garinii
FRVSKSHSSKEQNFIF

SEQ ID NO: 213242 - protein, 16 aa, Borrelia garinii
RVSKSHSSKEQNFIFY

SEQ ID NO: 213243 - protein, 16 aa, Borrelia garinii
VSKSHSSKEQNFIFYV

SEQ ID NO: 213244 - protein, 16 aa, Borrelia garinii
SKSHSSKEQNFIFYVK

SEQ ID NO: 213245 - protein, 16 aa, Borrelia garinii
KSHSSKEQNFIFYVKD

SEQ ID NO: 213246 - protein, 16 aa, Borrelia garinii
SHSSKEQNFIFYVKDL

SEQ ID NO: 213247 - protein, 16 aa, Borrelia garinii
HSSKEQNFIFYVKDLR

SEQ ID NO: 213248 - protein, 16 aa, Borrelia garinii
SSKEQNFIFYVKDLRV

SEQ ID NO: 213249 - protein, 16 aa, Borrelia garinii
SKEQNFIFYVKDLRVL

SEQ ID NO: 213250 - protein, 16 aa, Borrelia garinii
KEQNFIFYVKDLRVLY

SEQ ID NO: 213251 - protein, 16 aa, Borrelia garinii
EQNFIFYVKDLRVLYD

SEQ ID NO: 213252 - protein, 16 aa, Borrelia garinii
QNFIFYVKDLRVLYDK

SEQ ID NO: 213253 - protein, 16 aa, Borrelia garinii
NFIFYVKDLRVLYDKL

SEQ ID NO: 213254 - protein, 16 aa, Borrelia garinii
FIFYVKDLRVLYDKLS

SEQ ID NO: 213255 - protein, 16 aa, Borrelia garinii
IFYVKDLRVLYDKLSV

SEQ ID NO: 213256 - protein, 16 aa, Borrelia garinii
FYVKDLRVLYDKLSVS

SEQ ID NO: 213257 - protein, 16 aa, Borrelia garinii
YVKDLRVLYDKLSVSI

SEQ ID NO: 213258 - protein, 16 aa, Borrelia garinii
VKDLRVLYDKLSVSID

SEQ ID NO: 213259 - protein, 16 aa, Borrelia garinii
KDLRVLYDKLSVSIDS

SEQ ID NO: 213260 - protein, 16 aa, Borrelia garinii
DLRVLYDKLSVSIDSD

SEQ ID NO: 213261 - protein, 16 aa, Borrelia garinii
LRVLYDKLSVSIDSDI

SEQ ID NO: 213262 - protein, 16 aa, Borrelia garinii
RVLYDKLSVSIDSDID

SEQ ID NO: 213263 - protein, 16 aa, Borrelia garinii
VLYDKLSVSIDSDIDS

SEQ ID NO: 213264 - protein, 16 aa, Borrelia garinii
LYDKLSVSIDSDIDSE

SEQ ID NO: 213265 - protein, 16 aa, Borrelia garinii
YDKLSVSIDSDIDSES

SEQ ID NO: 213266 - protein, 16 aa, Borrelia garinii
DKLSVSIDSDIDSESV

SEQ ID NO: 213267 - protein, 16 aa, Borrelia garinii
KLSVSIDSDIDSESVF

SEQ ID NO: 213268 - protein, 16 aa, Borrelia garinii
LSVSIDSDIDSESVFK

SEQ ID NO: 213269 - protein, 16 aa, Borrelia garinii
SVSIDSDIDSESVFKV

SEQ ID NO: 213270 - protein, 16 aa, Borrelia garinii
VSIDSDIDSESVFKVY

SEQ ID NO: 213271 - protein, 16 aa, Borrelia garinii
SIDSDIDSESVFKVYE

SEQ ID NO: 213272 - protein, 16 aa, Borrelia garinii
IDSDIDSESVFKVYET

SEQ ID NO: 213273 - protein, 16 aa, Borrelia garinii
DSDIDSESVFKVYETS

SEQ ID NO: 213274 - protein, 16 aa, Borrelia garinii
SDIDSESVFKVYETSG

SEQ ID NO: 213275 - protein, 16 aa, Borrelia garinii
DIDSESVFKVYETSGT

SEQ ID NO: 213276 - protein, 16 aa, Borrelia garinii
IDSESVFKVYETSGTE

SEQ ID NO: 213277 - protein, 16 aa, Borrelia garinii
DSESVFKVYETSGTES

SEQ ID NO: 213278 - protein, 16 aa, Borrelia garinii
SESVFKVYETSGTESL

SEQ ID NO: 213279 - protein, 16 aa, Borrelia garinii
ESVFKVYETSGTESLR

SEQ ID NO: 213280 - protein, 16 aa, Borrelia garinii
SVFKVYETSGTESLRK

SEQ ID NO: 213281 - protein, 16 aa, Borrelia garinii
VFKVYETSGTESLRKL

SEQ ID NO: 213282 - protein, 16 aa, Borrelia garinii
FKVYETSGTESLRKLK

SEQ ID NO: 213283 - protein, 16 aa, Borrelia garinii
KVYETSGTESLRKLKA

SEQ ID NO: 213284 - protein, 16 aa, Borrelia garinii
VYETSGTESLRKLKAH

SEQ ID NO: 213285 - protein, 16 aa, Borrelia garinii
YETSGTESLRKLKAHE

SEQ ID NO: 213286 - protein, 16 aa, Borrelia garinii
ETSGTESLRKLKAHET

SEQ ID NO: 213287 - protein, 16 aa, Borrelia garinii
TSGTESLRKLKAHETF

SEQ ID NO: 213288 - protein, 16 aa, Borrelia garinii
SGTESLRKLKAHETFK

SEQ ID NO: 213289 - protein, 16 aa, Borrelia garinii
GTESLRKLKAHETFKR

SEQ ID NO: 213290 - protein, 16 aa, Borrelia garinii
TESLRKLKAHETFKRV

SEQ ID NO: 213291 - protein, 16 aa, Borrelia garinii
ESLRKLKAHETFKRVL

SEQ ID NO: 213292 - protein, 16 aa, Borrelia garinii
SLRKLKAHETFKRVLK

SEQ ID NO: 213293 - protein, 16 aa, Borrelia garinii
LRKLKAHETFKRVLKL

SEQ ID NO: 213294 - protein, 16 aa, Borrelia garinii
RKLKAHETFKRVLKLR

SEQ ID NO: 213295 - protein, 16 aa, Borrelia garinii
KLKAHETFKRVLKLRE

SEQ ID NO: 213296 - protein, 16 aa, Borrelia garinii
LKAHETFKRVLKLREK

SEQ ID NO: 213297 - protein, 16 aa, Borrelia garinii
KAHETFKRVLKLREKI

SEQ ID NO: 213298 - protein, 16 aa, Borrelia garinii
AHETFKRVLKLREKIS

SEQ ID NO: 213299 - protein, 16 aa, Borrelia garinii
HETFKRVLKLREKISM

SEQ ID NO: 213300 - protein, 16 aa, Borrelia garinii
ETFKRVLKLREKISMP

SEQ ID NO: 213301 - protein, 16 aa, Borrelia garinii
TFKRVLKLREKISMPE

SEQ ID NO: 213302 - protein, 16 aa, Borrelia garinii
FKRVLKLREKISMPEG

SEQ ID NO: 213303 - protein, 16 aa, Borrelia garinii
KRVLKLREKISMPEGS

SEQ ID NO: 213304 - protein, 16 aa, Borrelia garinii
RVLKLREKISMPEGSF

SEQ ID NO: 213305 - protein, 16 aa, Borrelia garinii
VLKLREKISMPEGSFQ

SEQ ID NO: 213306 - protein, 16 aa, Borrelia garinii
LKLREKISMPEGSFQN

SEQ ID NO: 213307 - protein, 16 aa, Borrelia garinii
KLREKISMPEGSFQNF

SEQ ID NO: 213308 - protein, 16 aa, Borrelia garinii
LREKISMPEGSFQNFI

SEQ ID NO: 213309 - protein, 16 aa, Borrelia garinii
REKISMPEGSFQNFIE

SEQ ID NO: 213310 - protein, 16 aa, Borrelia garinii
EKISMPEGSFQNFIEK

SEQ ID NO: 213311 - protein, 16 aa, Borrelia garinii
KISMPEGSFQNFIEKV

SEQ ID NO: 213312 - protein, 16 aa, Borrelia garinii
ISMPEGSFQNFIEKVE

SEQ ID NO: 213313 - protein, 16 aa, Borrelia garinii
SMPEGSFQNFIEKVES

SEQ ID NO: 213314 - protein, 16 aa, Borrelia garinii
MPEGSFQNFIEKVESE

SEQ ID NO: 213315 - protein, 16 aa, Borrelia garinii
PEGSFQNFIEKVESEK

SEQ ID NO: 213316 - protein, 16 aa, Borrelia garinii
EGSFQNFIEKVESEKK

SEQ ID NO: 213317 - protein, 16 aa, Borrelia garinii
GSFQNFIEKVESEKKP

SEQ ID NO: 213318 - protein, 16 aa, Borrelia garinii
SFQNFIEKVESEKKPE

SEQ ID NO: 213319 - protein, 16 aa, Borrelia garinii
FQNFIEKVESEKKPEE

SEQ ID NO: 213320 - protein, 16 aa, Borrelia garinii
QNFIEKVESEKKPEES

SEQ ID NO: 213321 - protein, 16 aa, Borrelia garinii
NFIEKVESEKKPEESS

SEQ ID NO: 213322 - protein, 16 aa, Borrelia garinii
FIEKVESEKKPEESSL

SEQ ID NO: 213323 - protein, 16 aa, Borrelia garinii
IEKVESEKKPEESSLK

SEQ ID NO: 213324 - protein, 16 aa, Borrelia garinii
EKVESEKKPEESSLKK

SEQ ID NO: 213325 - protein, 336 aa, Borrelia afzelii
MIINHNTSAINASRNNAINAANLSKTQEKLSSGYRINRASDDAAGMGVSGKINAQIRGLSQASRNTSKAINFIQTTEGNLNEVEKVLVRMKELAVQSGNGTYSDSDRGSIQIEIEQLTDEINRIADQAQYNQMHMLSNKSASQNVKTAEELGMQPAKINTPASLSGSQASWTLRVHVGANQDEAIAVNIYSANVANLFAGEGAQAAQAAPVQEGAQEEGAQQPTPATAPTQGGVNSPVNVTTTVDANTSLAKIENAIRMISDQRANLGAFQNRLESIKNSTEYAIENLKASYAQIKDATMTDEVVAATTNSILTQSAMAMIAQANQVPQYVLSLLR

SEQ ID NO: 213326 - protein, 8 aa, Borrelia afzelii
MIINHNTS

SEQ ID NO: 213327 - protein, 8 aa, Borrelia afzelii
IINHNTSA

SEQ ID NO: 213328 - protein, 8 aa, Borrelia afzelii
INHNTSAI

SEQ ID NO: 213329 - protein, 8 aa, Borrelia afzelii
NHNTSAIN

SEQ ID NO: 213330 - protein, 8 aa, Borrelia afzelii
HNTSAINA

SEQ ID NO: 213331 - protein, 8 aa, Borrelia afzelii
NTSAINAS

SEQ ID NO: 213332 - protein, 8 aa, Borrelia afzelii
TSAINASR

SEQ ID NO: 213333 - protein, 8 aa, Borrelia afzelii
SAINASRN

SEQ ID NO: 213334 - protein, 8 aa, Borrelia afzelii
AINASRNN

SEQ ID NO: 213335 - protein, 8 aa, Borrelia afzelii
INASRNNA

SEQ ID NO: 213336 - protein, 8 aa, Borrelia afzelii
NASRNNAI

SEQ ID NO: 213337 - protein, 8 aa, Borrelia afzelii
ASRNNAIN

SEQ ID NO: 213338 - protein, 8 aa, Borrelia afzelii
SRNNAINA

SEQ ID NO: 213339 - protein, 8 aa, Borrelia afzelii
RNNAINAA

SEQ ID NO: 213340 - protein, 8 aa, Borrelia afzelii
NNAINAAN

SEQ ID NO: 213341 - protein, 8 aa, Borrelia afzelii
NAINAANL

SEQ ID NO: 213342 - protein, 8 aa, Borrelia afzelii
AINAANLS

SEQ ID NO: 213343 - protein, 8 aa, Borrelia afzelii
INAANLSK

SEQ ID NO: 213344 - protein, 8 aa, Borrelia afzelii
NAANLSKT

SEQ ID NO: 213345 - protein, 8 aa, Borrelia afzelii
AANLSKTQ

SEQ ID NO: 213346 - protein, 8 aa, Borrelia afzelii
ANLSKTQE

SEQ ID NO: 213347 - protein, 8 aa, Borrelia afzelii
NLSKTQEK

SEQ ID NO: 213348 - protein, 8 aa, Borrelia afzelii
LSKTQEKL

SEQ ID NO: 213349 - protein, 8 aa, Borrelia afzelii
SKTQEKLS

SEQ ID NO: 213350 - protein, 8 aa, Borrelia afzelii
KTQEKLSS

SEQ ID NO: 213351 - protein, 8 aa, Borrelia afzelii
TQEKLSSG

SEQ ID NO: 213352 - protein, 8 aa, Borrelia afzelii
QEKLSSGY

SEQ ID NO: 213353 - protein, 8 aa, Borrelia afzelii
EKLSSGYR

SEQ ID NO: 213354 - protein, 8 aa, Borrelia afzelii
KLSSGYRI

SEQ ID NO: 213355 - protein, 8 aa, Borrelia afzelii
LSSGYRIN

SEQ ID NO: 213356 - protein, 8 aa, Borrelia afzelii
SSGYRINR

SEQ ID NO: 213357 - protein, 8 aa, Borrelia afzelii
SGYRINRA

SEQ ID NO: 213358 - protein, 8 aa, Borrelia afzelii
GYRINRAS

SEQ ID NO: 213359 - protein, 8 aa, Borrelia afzelii
YRINRASD

SEQ ID NO: 213360 - protein, 8 aa, Borrelia afzelii
RINRASDD

SEQ ID NO: 213361 - protein, 8 aa, Borrelia afzelii
INRASDDA

SEQ ID NO: 213362 - protein, 8 aa, Borrelia afzelii
NRASDDAA

SEQ ID NO: 213363 - protein, 8 aa, Borrelia afzelii
RASDDAAG

SEQ ID NO: 213364 - protein, 8 aa, Borrelia afzelii
ASDDAAGM

SEQ ID NO: 213365 - protein, 8 aa, Borrelia afzelii
SDDAAGMG

SEQ ID NO: 213366 - protein, 8 aa, Borrelia afzelii
DDAAGMGV

SEQ ID NO: 213367 - protein, 8 aa, Borrelia afzelii
DAAGMGVS

SEQ ID NO: 213368 - protein, 8 aa, Borrelia afzelii
AAGMGVSG

SEQ ID NO: 213369 - protein, 8 aa, Borrelia afzelii
AGMGVSGK

SEQ ID NO: 213370 - protein, 8 aa, Borrelia afzelii
GMGVSGKI

SEQ ID NO: 213371 - protein, 8 aa, Borrelia afzelii
MGVSGKIN

SEQ ID NO: 213372 - protein, 8 aa, Borrelia afzelii
GVSGKINA

SEQ ID NO: 213373 - protein, 8 aa, Borrelia afzelii
VSGKINAQ

SEQ ID NO: 213374 - protein, 8 aa, Borrelia afzelii
SGKINAQI

SEQ ID NO: 213375 - protein, 8 aa, Borrelia afzelii
GKINAQIR

SEQ ID NO: 213376 - protein, 8 aa, Borrelia afzelii
KINAQIRG

SEQ ID NO: 213377 - protein, 8 aa, Borrelia afzelii
INAQIRGL

SEQ ID NO: 213378 - protein, 8 aa, Borrelia afzelii
NAQIRGLS

SEQ ID NO: 213379 - protein, 8 aa, Borrelia afzelii
AQIRGLSQ

SEQ ID NO: 213380 - protein, 8 aa, Borrelia afzelii
QIRGLSQA

SEQ ID NO: 213381 - protein, 8 aa, Borrelia afzelii
IRGLSQAS

SEQ ID NO: 213382 - protein, 8 aa, Borrelia afzelii
RGLSQASR

SEQ ID NO: 213383 - protein, 8 aa, Borrelia afzelii
GLSQASRN

SEQ ID NO: 213384 - protein, 8 aa, Borrelia afzelii
LSQASRNT

SEQ ID NO: 213385 - protein, 8 aa, Borrelia afzelii
SQASRNTS

SEQ ID NO: 213386 - protein, 8 aa, Borrelia afzelii
QASRNTSK

SEQ ID NO: 213387 - protein, 8 aa, Borrelia afzelii
ASRNTSKA

SEQ ID NO: 213388 - protein, 8 aa, Borrelia afzelii
SRNTSKAI

SEQ ID NO: 213389 - protein, 8 aa, Borrelia afzelii
RNTSKAIN

SEQ ID NO: 213390 - protein, 8 aa, Borrelia afzelii
NTSKAINF

SEQ ID NO: 213391 - protein, 8 aa, Borrelia afzelii
TSKAINFI

SEQ ID NO: 213392 - protein, 8 aa, Borrelia afzelii
SKAINFIQ

SEQ ID NO: 213393 - protein, 8 aa, Borrelia afzelii
KAINFIQT

SEQ ID NO: 213394 - protein, 8 aa, Borrelia afzelii
AINFIQTT

SEQ ID NO: 213395 - protein, 8 aa, Borrelia afzelii
INFIQTTE

SEQ ID NO: 213396 - protein, 8 aa, Borrelia afzelii
NFIQTTEG

SEQ ID NO: 213397 - protein, 8 aa, Borrelia afzelii
FIQTTEGN

SEQ ID NO: 213398 - protein, 8 aa, Borrelia afzelii
IQTTEGNL

SEQ ID NO: 213399 - protein, 8 aa, Borrelia afzelii
QTTEGNLN

SEQ ID NO: 213400 - protein, 8 aa, Borrelia afzelii
TTEGNLNE

SEQ ID NO: 213401 - protein, 8 aa, Borrelia afzelii
TEGNLNEV

SEQ ID NO: 213402 - protein, 8 aa, Borrelia afzelii
EGNLNEVE

SEQ ID NO: 213403 - protein, 8 aa, Borrelia afzelii
GNLNEVEK

SEQ ID NO: 213404 - protein, 8 aa, Borrelia afzelii
NLNEVEKV

SEQ ID NO: 213405 - protein, 8 aa, Borrelia afzelii
LNEVEKVL

SEQ ID NO: 213406 - protein, 8 aa, Borrelia afzelii
NEVEKVLV

SEQ ID NO: 213407 - protein, 8 aa, Borrelia afzelii
EVEKVLVR

SEQ ID NO: 213408 - protein, 8 aa, Borrelia afzelii
VEKVLVRM

SEQ ID NO: 213409 - protein, 8 aa, Borrelia afzelii
EKVLVRMK

SEQ ID NO: 213410 - protein, 8 aa, Borrelia afzelii
KVLVRMKE

SEQ ID NO: 213411 - protein, 8 aa, Borrelia afzelii
VLVRMKEL

SEQ ID NO: 213412 - protein, 8 aa, Borrelia afzelii
LVRMKELA

SEQ ID NO: 213413 - protein, 8 aa, Borrelia afzelii
VRMKELAV

SEQ ID NO: 213414 - protein, 8 aa, Borrelia afzelii
RMKELAVQ

SEQ ID NO: 213415 - protein, 8 aa, Borrelia afzelii
MKELAVQS

SEQ ID NO: 213416 - protein, 8 aa, Borrelia afzelii
KELAVQSG

SEQ ID NO: 213417 - protein, 8 aa, Borrelia afzelii
ELAVQSGN

SEQ ID NO: 213418 - protein, 8 aa, Borrelia afzelii
LAVQSGNG

SEQ ID NO: 213419 - protein, 8 aa, Borrelia afzelii
AVQSGNGT

SEQ ID NO: 213420 - protein, 8 aa, Borrelia afzelii
VQSGNGTY

SEQ ID NO: 213421 - protein, 8 aa, Borrelia afzelii
QSGNGTYS

SEQ ID NO: 213422 - protein, 8 aa, Borrelia afzelii
SGNGTYSD

SEQ ID NO: 213423 - protein, 8 aa, Borrelia afzelii
GNGTYSDS

SEQ ID NO: 213424 - protein, 8 aa, Borrelia afzelii
NGTYSDSD

SEQ ID NO: 213425 - protein, 8 aa, Borrelia afzelii
GTYSDSDR

SEQ ID NO: 213426 - protein, 8 aa, Borrelia afzelii
TYSDSDRG

SEQ ID NO: 213427 - protein, 8 aa, Borrelia afzelii
YSDSDRGS

SEQ ID NO: 213428 - protein, 8 aa, Borrelia afzelii
SDSDRGSI

SEQ ID NO: 213429 - protein, 8 aa, Borrelia afzelii
DSDRGSIQ

SEQ ID NO: 213430 - protein, 8 aa, Borrelia afzelii
SDRGSIQI

SEQ ID NO: 213431 - protein, 8 aa, Borrelia afzelii
DRGSIQIE

SEQ ID NO: 213432 - protein, 8 aa, Borrelia afzelii
RGSIQIEI

SEQ ID NO: 213433 - protein, 8 aa, Borrelia afzelii
GSIQIEIE

SEQ ID NO: 213434 - protein, 8 aa, Borrelia afzelii
SIQIEIEQ

SEQ ID NO: 213435 - protein, 8 aa, Borrelia afzelii
IQIEIEQL

SEQ ID NO: 213436 - protein, 8 aa, Borrelia afzelii
QIEIEQLT

SEQ ID NO: 213437 - protein, 8 aa, Borrelia afzelii
IEIEQLTD

SEQ ID NO: 213438 - protein, 8 aa, Borrelia afzelii
EIEQLTDE

SEQ ID NO: 213439 - protein, 8 aa, Borrelia afzelii
IEQLTDEI

SEQ ID NO: 213440 - protein, 8 aa, Borrelia afzelii
EQLTDEIN

SEQ ID NO: 213441 - protein, 8 aa, Borrelia afzelii
QLTDEINR

SEQ ID NO: 213442 - protein, 8 aa, Borrelia afzelii
LTDEINRI

SEQ ID NO: 213443 - protein, 8 aa, Borrelia afzelii
TDEINRIA

SEQ ID NO: 213444 - protein, 8 aa, Borrelia afzelii
DEINRIAD

SEQ ID NO: 213445 - protein, 8 aa, Borrelia afzelii
EINRIADQ

SEQ ID NO: 213446 - protein, 8 aa, Borrelia afzelii
INRIADQA

SEQ ID NO: 213447 - protein, 8 aa, Borrelia afzelii
NRIADQAQ

SEQ ID NO: 213448 - protein, 8 aa, Borrelia afzelii
RIADQAQY

SEQ ID NO: 213449 - protein, 8 aa, Borrelia afzelii
IADQAQYN

SEQ ID NO: 213450 - protein, 8 aa, Borrelia afzelii
ADQAQYNQ

SEQ ID NO: 213451 - protein, 8 aa, Borrelia afzelii
DQAQYNQM

SEQ ID NO: 213452 - protein, 8 aa, Borrelia afzelii
QAQYNQMH

SEQ ID NO: 213453 - protein, 8 aa, Borrelia afzelii
AQYNQMHM

SEQ ID NO: 213454 - protein, 8 aa, Borrelia afzelii
QYNQMHML

SEQ ID NO: 213455 - protein, 8 aa, Borrelia afzelii
YNQMHMLS

SEQ ID NO: 213456 - protein, 8 aa, Borrelia afzelii
NQMHMLSN

SEQ ID NO: 213457 - protein, 8 aa, Borrelia afzelii
QMHMLSNK

SEQ ID NO: 213458 - protein, 8 aa, Borrelia afzelii
MHMLSNKS

SEQ ID NO: 213459 - protein, 8 aa, Borrelia afzelii
HMLSNKSA

SEQ ID NO: 213460 - protein, 8 aa, Borrelia afzelii
MLSNKSAS

SEQ ID NO: 213461 - protein, 8 aa, Borrelia afzelii
LSNKSASQ

SEQ ID NO: 213462 - protein, 8 aa, Borrelia afzelii
SNKSASQN

SEQ ID NO: 213463 - protein, 8 aa, Borrelia afzelii
NKSASQNV

SEQ ID NO: 213464 - protein, 8 aa, Borrelia afzelii
KSASQNVK

SEQ ID NO: 213465 - protein, 8 aa, Borrelia afzelii
SASQNVKT

SEQ ID NO: 213466 - protein, 8 aa, Borrelia afzelii
ASQNVKTA

SEQ ID NO: 213467 - protein, 8 aa, Borrelia afzelii
SQNVKTAE

SEQ ID NO: 213468 - protein, 8 aa, Borrelia afzelii
QNVKTAEE

SEQ ID NO: 213469 - protein, 8 aa, Borrelia afzelii
NVKTAEEL

SEQ ID NO: 213470 - protein, 8 aa, Borrelia afzelii
VKTAEELG

SEQ ID NO: 213471 - protein, 8 aa, Borrelia afzelii
KTAEELGM

SEQ ID NO: 213472 - protein, 8 aa, Borrelia afzelii
TAEELGMQ

SEQ ID NO: 213473 - protein, 8 aa, Borrelia afzelii
AEELGMQP

SEQ ID NO: 213474 - protein, 8 aa, Borrelia afzelii
EELGMQPA

SEQ ID NO: 213475 - protein, 8 aa, Borrelia afzelii
ELGMQPAK

SEQ ID NO: 213476 - protein, 8 aa, Borrelia afzelii
LGMQPAKI

SEQ ID NO: 213477 - protein, 8 aa, Borrelia afzelii
GMQPAKIN

SEQ ID NO: 213478 - protein, 8 aa, Borrelia afzelii
MQPAKINT

SEQ ID NO: 213479 - protein, 8 aa, Borrelia afzelii
QPAKINTP

SEQ ID NO: 213480 - protein, 8 aa, Borrelia afzelii
PAKINTPA

SEQ ID NO: 213481 - protein, 8 aa, Borrelia afzelii
AKINTPAS

SEQ ID NO: 213482 - protein, 8 aa, Borrelia afzelii
KINTPASL

SEQ ID NO: 213483 - protein, 8 aa, Borrelia afzelii
INTPASLS

SEQ ID NO: 213484 - protein, 8 aa, Borrelia afzelii
NTPASLSG

SEQ ID NO: 213485 - protein, 8 aa, Borrelia afzelii
TPASLSGS

SEQ ID NO: 213486 - protein, 8 aa, Borrelia afzelii
PASLSGSQ

SEQ ID NO: 213487 - protein, 8 aa, Borrelia afzelii
ASLSGSQA

SEQ ID NO: 213488 - protein, 8 aa, Borrelia afzelii
SLSGSQAS

SEQ ID NO: 213489 - protein, 8 aa, Borrelia afzelii
LSGSQASW

SEQ ID NO: 213490 - protein, 8 aa, Borrelia afzelii
SGSQASWT

SEQ ID NO: 213491 - protein, 8 aa, Borrelia afzelii
GSQASWTL

SEQ ID NO: 213492 - protein, 8 aa, Borrelia afzelii
SQASWTLR

SEQ ID NO: 213493 - protein, 8 aa, Borrelia afzelii
QASWTLRV

SEQ ID NO: 213494 - protein, 8 aa, Borrelia afzelii
ASWTLRVH

SEQ ID NO: 213495 - protein, 8 aa, Borrelia afzelii
SWTLRVHV

SEQ ID NO: 213496 - protein, 8 aa, Borrelia afzelii
WTLRVHVG

SEQ ID NO: 213497 - protein, 8 aa, Borrelia afzelii
TLRVHVGA

SEQ ID NO: 213498 - protein, 8 aa, Borrelia afzelii
LRVHVGAN

SEQ ID NO: 213499 - protein, 8 aa, Borrelia afzelii
RVHVGANQ

SEQ ID NO: 213500 - protein, 8 aa, Borrelia afzelii
VHVGANQD

SEQ ID NO: 213501 - protein, 8 aa, Borrelia afzelii
HVGANQDE

SEQ ID NO: 213502 - protein, 8 aa, Borrelia afzelii
VGANQDEA

SEQ ID NO: 213503 - protein, 8 aa, Borrelia afzelii
GANQDEAI

SEQ ID NO: 213504 - protein, 8 aa, Borrelia afzelii
ANQDEAIA

SEQ ID NO: 213505 - protein, 8 aa, Borrelia afzelii
NQDEAIAV

SEQ ID NO: 213506 - protein, 8 aa, Borrelia afzelii
QDEAIAVN

SEQ ID NO: 213507 - protein, 8 aa, Borrelia afzelii
DEAIAVNI

SEQ ID NO: 213508 - protein, 8 aa, Borrelia afzelii
EAIAVNIY

SEQ ID NO: 213509 - protein, 8 aa, Borrelia afzelii
AIAVNIYS

SEQ ID NO: 213510 - protein, 8 aa, Borrelia afzelii
IAVNIYSA

SEQ ID NO: 213511 - protein, 8 aa, Borrelia afzelii
AVNIYSAN

SEQ ID NO: 213512 - protein, 8 aa, Borrelia afzelii
VNIYSANV

SEQ ID NO: 213513 - protein, 8 aa, Borrelia afzelii
NIYSANVA

SEQ ID NO: 213514 - protein, 8 aa, Borrelia afzelii
IYSANVAN

SEQ ID NO: 213515 - protein, 8 aa, Borrelia afzelii
YSANVANL

SEQ ID NO: 213516 - protein, 8 aa, Borrelia afzelii
SANVANLF

SEQ ID NO: 213517 - protein, 8 aa, Borrelia afzelii
ANVANLFA

SEQ ID NO: 213518 - protein, 8 aa, Borrelia afzelii
NVANLFAG

SEQ ID NO: 213519 - protein, 8 aa, Borrelia afzelii
VANLFAGE

SEQ ID NO: 213520 - protein, 8 aa, Borrelia afzelii
ANLFAGEG

SEQ ID NO: 213521 - protein, 8 aa, Borrelia afzelii
NLFAGEGA

SEQ ID NO: 213522 - protein, 8 aa, Borrelia afzelii
LFAGEGAQ

SEQ ID NO: 213523 - protein, 8 aa, Borrelia afzelii
FAGEGAQA

SEQ ID NO: 213524 - protein, 8 aa, Borrelia afzelii
AGEGAQAA

SEQ ID NO: 213525 - protein, 8 aa, Borrelia afzelii
GEGAQAAQ

SEQ ID NO: 213526 - protein, 8 aa, Borrelia afzelii
EGAQAAQA

SEQ ID NO: 213527 - protein, 8 aa, Borrelia afzelii
GAQAAQAA

SEQ ID NO: 213528 - protein, 8 aa, Borrelia afzelii
AQAAQAAP

SEQ ID NO: 213529 - protein, 8 aa, Borrelia afzelii
QAAQAAPV

SEQ ID NO: 213530 - protein, 8 aa, Borrelia afzelii
AAQAAPVQ

SEQ ID NO: 213531 - protein, 8 aa, Borrelia afzelii
AQAAPVQE

SEQ ID NO: 213532 - protein, 8 aa, Borrelia afzelii
QAAPVQEG

SEQ ID NO: 213533 - protein, 8 aa, Borrelia afzelii
AAPVQEGA

SEQ ID NO: 213534 - protein, 8 aa, Borrelia afzelii
APVQEGAQ

SEQ ID NO: 213535 - protein, 8 aa, Borrelia afzelii
PVQEGAQE

SEQ ID NO: 213536 - protein, 8 aa, Borrelia afzelii
VQEGAQEE

SEQ ID NO: 213537 - protein, 8 aa, Borrelia afzelii
QEGAQEEG

SEQ ID NO: 213538 - protein, 8 aa, Borrelia afzelii
EGAQEEGA

SEQ ID NO: 213539 - protein, 8 aa, Borrelia afzelii
GAQEEGAQ

SEQ ID NO: 213540 - protein, 8 aa, Borrelia afzelii
AQEEGAQQ

SEQ ID NO: 213541 - protein, 8 aa, Borrelia afzelii
QEEGAQQP

SEQ ID NO: 213542 - protein, 8 aa, Borrelia afzelii
EEGAQQPT

SEQ ID NO: 213543 - protein, 8 aa, Borrelia afzelii
EGAQQPTP

SEQ ID NO: 213544 - protein, 8 aa, Borrelia afzelii
GAQQPTPA

SEQ ID NO: 213545 - protein, 8 aa, Borrelia afzelii
AQQPTPAT

SEQ ID NO: 213546 - protein, 8 aa, Borrelia afzelii
QQPTPATA

SEQ ID NO: 213547 - protein, 8 aa, Borrelia afzelii
QPTPATAP

SEQ ID NO: 213548 - protein, 8 aa, Borrelia afzelii
PTPATAPT

SEQ ID NO: 213549 - protein, 8 aa, Borrelia afzelii
TPATAPTQ

SEQ ID NO: 213550 - protein, 8 aa, Borrelia afzelii
PATAPTQG

SEQ ID NO: 213551 - protein, 8 aa, Borrelia afzelii
ATAPTQGG

SEQ ID NO: 213552 - protein, 8 aa, Borrelia afzelii
TAPTQGGV

SEQ ID NO: 213553 - protein, 8 aa, Borrelia afzelii
APTQGGVN

SEQ ID NO: 213554 - protein, 8 aa, Borrelia afzelii
PTQGGVNS

SEQ ID NO: 213555 - protein, 8 aa, Borrelia afzelii
TQGGVNSP

SEQ ID NO: 213556 - protein, 8 aa, Borrelia afzelii
QGGVNSPV

SEQ ID NO: 213557 - protein, 8 aa, Borrelia afzelii
GGVNSPVN

SEQ ID NO: 213558 - protein, 8 aa, Borrelia afzelii
GVNSPVNV

SEQ ID NO: 213559 - protein, 8 aa, Borrelia afzelii
VNSPVNVT

SEQ ID NO: 213560 - protein, 8 aa, Borrelia afzelii
NSPVNVTT

SEQ ID NO: 213561 - protein, 8 aa, Borrelia afzelii
SPVNVTTT

SEQ ID NO: 213562 - protein, 8 aa, Borrelia afzelii
PVNVTTTV

SEQ ID NO: 213563 - protein, 8 aa, Borrelia afzelii
VNVTTTVD

SEQ ID NO: 213564 - protein, 8 aa, Borrelia afzelii
NVTTTVDA

SEQ ID NO: 213565 - protein, 8 aa, Borrelia afzelii
VTTTVDAN

SEQ ID NO: 213566 - protein, 8 aa, Borrelia afzelii
TTTVDANT

SEQ ID NO: 213567 - protein, 8 aa, Borrelia afzelii
TTVDANTS

SEQ ID NO: 213568 - protein, 8 aa, Borrelia afzelii
TVDANTSL

SEQ ID NO: 213569 - protein, 8 aa, Borrelia afzelii
VDANTSLA

SEQ ID NO: 213570 - protein, 8 aa, Borrelia afzelii
DANTSLAK

SEQ ID NO: 213571 - protein, 8 aa, Borrelia afzelii
ANTSLAKI

SEQ ID NO: 213572 - protein, 8 aa, Borrelia afzelii
NTSLAKIE

SEQ ID NO: 213573 - protein, 8 aa, Borrelia afzelii
TSLAKIEN

SEQ ID NO: 213574 - protein, 8 aa, Borrelia afzelii
SLAKIENA

SEQ ID NO: 213575 - protein, 8 aa, Borrelia afzelii
LAKIENAI

SEQ ID NO: 213576 - protein, 8 aa, Borrelia afzelii
AKIENAIR

SEQ ID NO: 213577 - protein, 8 aa, Borrelia afzelii
KIENAIRM

SEQ ID NO: 213578 - protein, 8 aa, Borrelia afzelii
IENAIRMI

SEQ ID NO: 213579 - protein, 8 aa, Borrelia afzelii
ENAIRMIS

SEQ ID NO: 213580 - protein, 8 aa, Borrelia afzelii
NAIRMISD

SEQ ID NO: 213581 - protein, 8 aa, Borrelia afzelii
AIRMISDQ

SEQ ID NO: 213582 - protein, 8 aa, Borrelia afzelii
IRMISDQR

SEQ ID NO: 213583 - protein, 8 aa, Borrelia afzelii
RMISDQRA

SEQ ID NO: 213584 - protein, 8 aa, Borrelia afzelii
MISDQRAN

SEQ ID NO: 213585 - protein, 8 aa, Borrelia afzelii
ISDQRANL

SEQ ID NO: 213586 - protein, 8 aa, Borrelia afzelii
SDQRANLG

SEQ ID NO: 213587 - protein, 8 aa, Borrelia afzelii
DQRANLGA

SEQ ID NO: 213588 - protein, 8 aa, Borrelia afzelii
QRANLGAF

SEQ ID NO: 213589 - protein, 8 aa, Borrelia afzelii
RANLGAFQ

SEQ ID NO: 213590 - protein, 8 aa, Borrelia afzelii
ANLGAFQN

SEQ ID NO: 213591 - protein, 8 aa, Borrelia afzelii
NLGAFQNR

SEQ ID NO: 213592 - protein, 8 aa, Borrelia afzelii
LGAFQNRL

SEQ ID NO: 213593 - protein, 8 aa, Borrelia afzelii
GAFQNRLE

SEQ ID NO: 213594 - protein, 8 aa, Borrelia afzelii
AFQNRLES

SEQ ID NO: 213595 - protein, 8 aa, Borrelia afzelii
FQNRLESI

SEQ ID NO: 213596 - protein, 8 aa, Borrelia afzelii
QNRLESIK

SEQ ID NO: 213597 - protein, 8 aa, Borrelia afzelii
NRLESIKN

SEQ ID NO: 213598 - protein, 8 aa, Borrelia afzelii
RLESIKNS

SEQ ID NO: 213599 - protein, 8 aa, Borrelia afzelii
LESIKNST

SEQ ID NO: 213600 - protein, 8 aa, Borrelia afzelii
ESIKNSTE

SEQ ID NO: 213601 - protein, 8 aa, Borrelia afzelii
SIKNSTEY

SEQ ID NO: 213602 - protein, 8 aa, Borrelia afzelii
IKNSTEYA

SEQ ID NO: 213603 - protein, 8 aa, Borrelia afzelii
KNSTEYAI

SEQ ID NO: 213604 - protein, 8 aa, Borrelia afzelii
NSTEYAIE

SEQ ID NO: 213605 - protein, 8 aa, Borrelia afzelii
STEYAIEN

SEQ ID NO: 213606 - protein, 8 aa, Borrelia afzelii
TEYAIENL

SEQ ID NO: 213607 - protein, 8 aa, Borrelia afzelii
EYAIENLK

SEQ ID NO: 213608 - protein, 8 aa, Borrelia afzelii
YAIENLKA

SEQ ID NO: 213609 - protein, 8 aa, Borrelia afzelii
AIENLKAS

SEQ ID NO: 213610 - protein, 8 aa, Borrelia afzelii
IENLKASY

SEQ ID NO: 213611 - protein, 8 aa, Borrelia afzelii
ENLKASYA

SEQ ID NO: 213612 - protein, 8 aa, Borrelia afzelii
NLKASYAQ

SEQ ID NO: 213613 - protein, 8 aa, Borrelia afzelii
LKASYAQI

SEQ ID NO: 213614 - protein, 8 aa, Borrelia afzelii
KASYAQIK

SEQ ID NO: 213615 - protein, 8 aa, Borrelia afzelii
ASYAQIKD

SEQ ID NO: 213616 - protein, 8 aa, Borrelia afzelii
SYAQIKDA

SEQ ID NO: 213617 - protein, 8 aa, Borrelia afzelii
YAQIKDAT

SEQ ID NO: 213618 - protein, 8 aa, Borrelia afzelii
AQIKDATM

SEQ ID NO: 213619 - protein, 8 aa, Borrelia afzelii
QIKDATMT

SEQ ID NO: 213620 - protein, 8 aa, Borrelia afzelii
IKDATMTD

SEQ ID NO: 213621 - protein, 8 aa, Borrelia afzelii
KDATMTDE

SEQ ID NO: 213622 - protein, 8 aa, Borrelia afzelii
DATMTDEV

SEQ ID NO: 213623 - protein, 8 aa, Borrelia afzelii
ATMTDEVV

SEQ ID NO: 213624 - protein, 8 aa, Borrelia afzelii
TMTDEVVA

SEQ ID NO: 213625 - protein, 8 aa, Borrelia afzelii
MTDEVVAA

SEQ ID NO: 213626 - protein, 8 aa, Borrelia afzelii
TDEVVAAT

SEQ ID NO: 213627 - protein, 8 aa, Borrelia afzelii
DEVVAATT

SEQ ID NO: 213628 - protein, 8 aa, Borrelia afzelii
EVVAATTN

SEQ ID NO: 213629 - protein, 8 aa, Borrelia afzelii
VVAATTNS

SEQ ID NO: 213630 - protein, 8 aa, Borrelia afzelii
VAATTNSI

SEQ ID NO: 213631 - protein, 8 aa, Borrelia afzelii
AATTNSIL

SEQ ID NO: 213632 - protein, 8 aa, Borrelia afzelii
ATTNSILT

SEQ ID NO: 213633 - protein, 8 aa, Borrelia afzelii
TTNSILTQ

SEQ ID NO: 213634 - protein, 8 aa, Borrelia afzelii
TNSILTQS

SEQ ID NO: 213635 - protein, 8 aa, Borrelia afzelii
NSILTQSA

SEQ ID NO: 213636 - protein, 8 aa, Borrelia afzelii
SILTQSAM

SEQ ID NO: 213637 - protein, 8 aa, Borrelia afzelii
ILTQSAMA

SEQ ID NO: 213638 - protein, 8 aa, Borrelia afzelii
LTQSAMAM

SEQ ID NO: 213639 - protein, 8 aa, Borrelia afzelii
TQSAMAMI

SEQ ID NO: 213640 - protein, 8 aa, Borrelia afzelii
QSAMAMIA

SEQ ID NO: 213641 - protein, 8 aa, Borrelia afzelii
SAMAMIAQ

SEQ ID NO: 213642 - protein, 8 aa, Borrelia afzelii
AMAMIAQA

SEQ ID NO: 213643 - protein, 8 aa, Borrelia afzelii
MAMIAQAN

SEQ ID NO: 213644 - protein, 8 aa, Borrelia afzelii
AMIAQANQ

SEQ ID NO: 213645 - protein, 8 aa, Borrelia afzelii
MIAQANQV

SEQ ID NO: 213646 - protein, 8 aa, Borrelia afzelii
IAQANQVP

SEQ ID NO: 213647 - protein, 8 aa, Borrelia afzelii
AQANQVPQ

SEQ ID NO: 213648 - protein, 8 aa, Borrelia afzelii
QANQVPQY

SEQ ID NO: 213649 - protein, 8 aa, Borrelia afzelii
ANQVPQYV

SEQ ID NO: 213650 - protein, 8 aa, Borrelia afzelii
NQVPQYVL

SEQ ID NO: 213651 - protein, 8 aa, Borrelia afzelii
QVPQYVLS

SEQ ID NO: 213652 - protein, 8 aa, Borrelia afzelii
VPQYVLSL

SEQ ID NO: 213653 - protein, 8 aa, Borrelia afzelii
PQYVLSLL

SEQ ID NO: 213654 - protein, 8 aa, Borrelia afzelii
QYVLSLLR

SEQ ID NO: 213655 - protein, 9 aa, Borrelia afzelii
MIINHNTSA

SEQ ID NO: 213656 - protein, 9 aa, Borrelia afzelii
IINHNTSAI

SEQ ID NO: 213657 - protein, 9 aa, Borrelia afzelii
INHNTSAIN

SEQ ID NO: 213658 - protein, 9 aa, Borrelia afzelii
NHNTSAINA

SEQ ID NO: 213659 - protein, 9 aa, Borrelia afzelii
HNTSAINAS

SEQ ID NO: 213660 - protein, 9 aa, Borrelia afzelii
NTSAINASR

SEQ ID NO: 213661 - protein, 9 aa, Borrelia afzelii
TSAINASRN

SEQ ID NO: 213662 - protein, 9 aa, Borrelia afzelii
SAINASRNN

SEQ ID NO: 213663 - protein, 9 aa, Borrelia afzelii
AINASRNNA

SEQ ID NO: 213664 - protein, 9 aa, Borrelia afzelii
INASRNNAI

SEQ ID NO: 213665 - protein, 9 aa, Borrelia afzelii
NASRNNAIN

SEQ ID NO: 213666 - protein, 9 aa, Borrelia afzelii
ASRNNAINA

SEQ ID NO: 213667 - protein, 9 aa, Borrelia afzelii
SRNNAINAA

SEQ ID NO: 213668 - protein, 9 aa, Borrelia afzelii
RNNAINAAN

SEQ ID NO: 213669 - protein, 9 aa, Borrelia afzelii
NNAINAANL

SEQ ID NO: 213670 - protein, 9 aa, Borrelia afzelii
NAINAANLS

SEQ ID NO: 213671 - protein, 9 aa, Borrelia afzelii
AINAANLSK

SEQ ID NO: 213672 - protein, 9 aa, Borrelia afzelii
INAANLSKT

SEQ ID NO: 213673 - protein, 9 aa, Borrelia afzelii
NAANLSKTQ

SEQ ID NO: 213674 - protein, 9 aa, Borrelia afzelii
AANLSKTQE

SEQ ID NO: 213675 - protein, 9 aa, Borrelia afzelii
ANLSKTQEK

SEQ ID NO: 213676 - protein, 9 aa, Borrelia afzelii
NLSKTQEKL

SEQ ID NO: 213677 - protein, 9 aa, Borrelia afzelii
LSKTQEKLS

SEQ ID NO: 213678 - protein, 9 aa, Borrelia afzelii
SKTQEKLSS

SEQ ID NO: 213679 - protein, 9 aa, Borrelia afzelii
KTQEKLSSG

SEQ ID NO: 213680 - protein, 9 aa, Borrelia afzelii
TQEKLSSGY

SEQ ID NO: 213681 - protein, 9 aa, Borrelia afzelii
QEKLSSGYR

SEQ ID NO: 213682 - protein, 9 aa, Borrelia afzelii
EKLSSGYRI

SEQ ID NO: 213683 - protein, 9 aa, Borrelia afzelii
KLSSGYRIN

SEQ ID NO: 213684 - protein, 9 aa, Borrelia afzelii
LSSGYRINR

SEQ ID NO: 213685 - protein, 9 aa, Borrelia afzelii
SSGYRINRA

SEQ ID NO: 213686 - protein, 9 aa, Borrelia afzelii
SGYRINRAS

SEQ ID NO: 213687 - protein, 9 aa, Borrelia afzelii
GYRINRASD

SEQ ID NO: 213688 - protein, 9 aa, Borrelia afzelii
YRINRASDD

SEQ ID NO: 213689 - protein, 9 aa, Borrelia afzelii
RINRASDDA

SEQ ID NO: 213690 - protein, 9 aa, Borrelia afzelii
INRASDDAA

SEQ ID NO: 213691 - protein, 9 aa, Borrelia afzelii
NRASDDAAG

SEQ ID NO: 213692 - protein, 9 aa, Borrelia afzelii
RASDDAAGM

SEQ ID NO: 213693 - protein, 9 aa, Borrelia afzelii
ASDDAAGMG

SEQ ID NO: 213694 - protein, 9 aa, Borrelia afzelii
SDDAAGMGV

SEQ ID NO: 213695 - protein, 9 aa, Borrelia afzelii
DDAAGMGVS

SEQ ID NO: 213696 - protein, 9 aa, Borrelia afzelii
DAAGMGVSG

SEQ ID NO: 213697 - protein, 9 aa, Borrelia afzelii
AAGMGVSGK

SEQ ID NO: 213698 - protein, 9 aa, Borrelia afzelii
AGMGVSGKI

SEQ ID NO: 213699 - protein, 9 aa, Borrelia afzelii
GMGVSGKIN

SEQ ID NO: 213700 - protein, 9 aa, Borrelia afzelii
MGVSGKINA

SEQ ID NO: 213701 - protein, 9 aa, Borrelia afzelii
GVSGKINAQ

SEQ ID NO: 213702 - protein, 9 aa, Borrelia afzelii
VSGKINAQI

SEQ ID NO: 213703 - protein, 9 aa, Borrelia afzelii
SGKINAQIR

SEQ ID NO: 213704 - protein, 9 aa, Borrelia afzelii
GKINAQIRG

SEQ ID NO: 213705 - protein, 9 aa, Borrelia afzelii
KINAQIRGL

SEQ ID NO: 213706 - protein, 9 aa, Borrelia afzelii
INAQIRGLS

SEQ ID NO: 213707 - protein, 9 aa, Borrelia afzelii
NAQIRGLSQ

SEQ ID NO: 213708 - protein, 9 aa, Borrelia afzelii
AQIRGLSQA

SEQ ID NO: 213709 - protein, 9 aa, Borrelia afzelii
QIRGLSQAS

SEQ ID NO: 213710 - protein, 9 aa, Borrelia afzelii
IRGLSQASR

SEQ ID NO: 213711 - protein, 9 aa, Borrelia afzelii
RGLSQASRN

SEQ ID NO: 213712 - protein, 9 aa, Borrelia afzelii
GLSQASRNT

SEQ ID NO: 213713 - protein, 9 aa, Borrelia afzelii
LSQASRNTS

SEQ ID NO: 213714 - protein, 9 aa, Borrelia afzelii
SQASRNTSK

SEQ ID NO: 213715 - protein, 9 aa, Borrelia afzelii
QASRNTSKA

SEQ ID NO: 213716 - protein, 9 aa, Borrelia afzelii
ASRNTSKAI

SEQ ID NO: 213717 - protein, 9 aa, Borrelia afzelii
SRNTSKAIN

SEQ ID NO: 213718 - protein, 9 aa, Borrelia afzelii
RNTSKAINF

SEQ ID NO: 213719 - protein, 9 aa, Borrelia afzelii
NTSKAINFI

SEQ ID NO: 213720 - protein, 9 aa, Borrelia afzelii
TSKAINFIQ

SEQ ID NO: 213721 - protein, 9 aa, Borrelia afzelii
SKAINFIQT

SEQ ID NO: 213722 - protein, 9 aa, Borrelia afzelii
KAINFIQTT

SEQ ID NO: 213723 - protein, 9 aa, Borrelia afzelii
AINFIQTTE

SEQ ID NO: 213724 - protein, 9 aa, Borrelia afzelii
INFIQTTEG

SEQ ID NO: 213725 - protein, 9 aa, Borrelia afzelii
NFIQTTEGN

SEQ ID NO: 213726 - protein, 9 aa, Borrelia afzelii
FIQTTEGNL

SEQ ID NO: 213727 - protein, 9 aa, Borrelia afzelii
IQTTEGNLN

SEQ ID NO: 213728 - protein, 9 aa, Borrelia afzelii
QTTEGNLNE

SEQ ID NO: 213729 - protein, 9 aa, Borrelia afzelii
TTEGNLNEV

SEQ ID NO: 213730 - protein, 9 aa, Borrelia afzelii
TEGNLNEVE

SEQ ID NO: 213731 - protein, 9 aa, Borrelia afzelii
EGNLNEVEK

SEQ ID NO: 213732 - protein, 9 aa, Borrelia afzelii
GNLNEVEKV

SEQ ID NO: 213733 - protein, 9 aa, Borrelia afzelii
NLNEVEKVL

SEQ ID NO: 213734 - protein, 9 aa, Borrelia afzelii
LNEVEKVLV

SEQ ID NO: 213735 - protein, 9 aa, Borrelia afzelii
NEVEKVLVR

SEQ ID NO: 213736 - protein, 9 aa, Borrelia afzelii
EVEKVLVRM

SEQ ID NO: 213737 - protein, 9 aa, Borrelia afzelii
VEKVLVRMK

SEQ ID NO: 213738 - protein, 9 aa, Borrelia afzelii
EKVLVRMKE

SEQ ID NO: 213739 - protein, 9 aa, Borrelia afzelii
KVLVRMKEL

SEQ ID NO: 213740 - protein, 9 aa, Borrelia afzelii
VLVRMKELA

SEQ ID NO: 213741 - protein, 9 aa, Borrelia afzelii
LVRMKELAV

SEQ ID NO: 213742 - protein, 9 aa, Borrelia afzelii
VRMKELAVQ

SEQ ID NO: 213743 - protein, 9 aa, Borrelia afzelii
RMKELAVQS

SEQ ID NO: 213744 - protein, 9 aa, Borrelia afzelii
MKELAVQSG

SEQ ID NO: 213745 - protein, 9 aa, Borrelia afzelii
KELAVQSGN

SEQ ID NO: 213746 - protein, 9 aa, Borrelia afzelii
ELAVQSGNG

SEQ ID NO: 213747 - protein, 9 aa, Borrelia afzelii
LAVQSGNGT

SEQ ID NO: 213748 - protein, 9 aa, Borrelia afzelii
AVQSGNGTY

SEQ ID NO: 213749 - protein, 9 aa, Borrelia afzelii
VQSGNGTYS

SEQ ID NO: 213750 - protein, 9 aa, Borrelia afzelii
QSGNGTYSD

SEQ ID NO: 213751 - protein, 9 aa, Borrelia afzelii
SGNGTYSDS

SEQ ID NO: 213752 - protein, 9 aa, Borrelia afzelii
GNGTYSDSD

SEQ ID NO: 213753 - protein, 9 aa, Borrelia afzelii
NGTYSDSDR

SEQ ID NO: 213754 - protein, 9 aa, Borrelia afzelii
GTYSDSDRG

SEQ ID NO: 213755 - protein, 9 aa, Borrelia afzelii
TYSDSDRGS

SEQ ID NO: 213756 - protein, 9 aa, Borrelia afzelii
YSDSDRGSI

SEQ ID NO: 213757 - protein, 9 aa, Borrelia afzelii
SDSDRGSIQ

SEQ ID NO: 213758 - protein, 9 aa, Borrelia afzelii
DSDRGSIQI

SEQ ID NO: 213759 - protein, 9 aa, Borrelia afzelii
SDRGSIQIE

SEQ ID NO: 213760 - protein, 9 aa, Borrelia afzelii
DRGSIQIEI

SEQ ID NO: 213761 - protein, 9 aa, Borrelia afzelii
RGSIQIEIE

SEQ ID NO: 213762 - protein, 9 aa, Borrelia afzelii
GSIQIEIEQ

SEQ ID NO: 213763 - protein, 9 aa, Borrelia afzelii
SIQIEIEQL

SEQ ID NO: 213764 - protein, 9 aa, Borrelia afzelii
IQIEIEQLT

SEQ ID NO: 213765 - protein, 9 aa, Borrelia afzelii
QIEIEQLTD

SEQ ID NO: 213766 - protein, 9 aa, Borrelia afzelii
IEIEQLTDE

SEQ ID NO: 213767 - protein, 9 aa, Borrelia afzelii
EIEQLTDEI

SEQ ID NO: 213768 - protein, 9 aa, Borrelia afzelii
IEQLTDEIN

SEQ ID NO: 213769 - protein, 9 aa, Borrelia afzelii
EQLTDEINR

SEQ ID NO: 213770 - protein, 9 aa, Borrelia afzelii
QLTDEINRI

SEQ ID NO: 213771 - protein, 9 aa, Borrelia afzelii
LTDEINRIA

SEQ ID NO: 213772 - protein, 9 aa, Borrelia afzelii
TDEINRIAD

SEQ ID NO: 213773 - protein, 9 aa, Borrelia afzelii
DEINRIADQ

SEQ ID NO: 213774 - protein, 9 aa, Borrelia afzelii
EINRIADQA

SEQ ID NO: 213775 - protein, 9 aa, Borrelia afzelii
INRIADQAQ

SEQ ID NO: 213776 - protein, 9 aa, Borrelia afzelii
NRIADQAQY

SEQ ID NO: 213777 - protein, 9 aa, Borrelia afzelii
RIADQAQYN

SEQ ID NO: 213778 - protein, 9 aa, Borrelia afzelii
IADQAQYNQ

SEQ ID NO: 213779 - protein, 9 aa, Borrelia afzelii
ADQAQYNQM

SEQ ID NO: 213780 - protein, 9 aa, Borrelia afzelii
DQAQYNQMH

SEQ ID NO: 213781 - protein, 9 aa, Borrelia afzelii
QAQYNQMHM

SEQ ID NO: 213782 - protein, 9 aa, Borrelia afzelii
AQYNQMHML

SEQ ID NO: 213783 - protein, 9 aa, Borrelia afzelii
QYNQMHMLS

SEQ ID NO: 213784 - protein, 9 aa, Borrelia afzelii
YNQMHMLSN

SEQ ID NO: 213785 - protein, 9 aa, Borrelia afzelii
NQMHMLSNK

SEQ ID NO: 213786 - protein, 9 aa, Borrelia afzelii
QMHMLSNKS

SEQ ID NO: 213787 - protein, 9 aa, Borrelia afzelii
MHMLSNKSA

SEQ ID NO: 213788 - protein, 9 aa, Borrelia afzelii
HMLSNKSAS

SEQ ID NO: 213789 - protein, 9 aa, Borrelia afzelii
MLSNKSASQ

SEQ ID NO: 213790 - protein, 9 aa, Borrelia afzelii
LSNKSASQN

SEQ ID NO: 213791 - protein, 9 aa, Borrelia afzelii
SNKSASQNV

SEQ ID NO: 213792 - protein, 9 aa, Borrelia afzelii
NKSASQNVK

SEQ ID NO: 213793 - protein, 9 aa, Borrelia afzelii
KSASQNVKT

SEQ ID NO: 213794 - protein, 9 aa, Borrelia afzelii
SASQNVKTA

SEQ ID NO: 213795 - protein, 9 aa, Borrelia afzelii
ASQNVKTAE

SEQ ID NO: 213796 - protein, 9 aa, Borrelia afzelii
SQNVKTAEE

SEQ ID NO: 213797 - protein, 9 aa, Borrelia afzelii
QNVKTAEEL

SEQ ID NO: 213798 - protein, 9 aa, Borrelia afzelii
NVKTAEELG

SEQ ID NO: 213799 - protein, 9 aa, Borrelia afzelii
VKTAEELGM

SEQ ID NO: 213800 - protein, 9 aa, Borrelia afzelii
KTAEELGMQ

SEQ ID NO: 213801 - protein, 9 aa, Borrelia afzelii
TAEELGMQP

SEQ ID NO: 213802 - protein, 9 aa, Borrelia afzelii
AEELGMQPA

SEQ ID NO: 213803 - protein, 9 aa, Borrelia afzelii
EELGMQPAK

SEQ ID NO: 213804 - protein, 9 aa, Borrelia afzelii
ELGMQPAKI

SEQ ID NO: 213805 - protein, 9 aa, Borrelia afzelii
LGMQPAKIN

SEQ ID NO: 213806 - protein, 9 aa, Borrelia afzelii
GMQPAKINT

SEQ ID NO: 213807 - protein, 9 aa, Borrelia afzelii
MQPAKINTP

SEQ ID NO: 213808 - protein, 9 aa, Borrelia afzelii
QPAKINTPA

SEQ ID NO: 213809 - protein, 9 aa, Borrelia afzelii
PAKINTPAS

SEQ ID NO: 213810 - protein, 9 aa, Borrelia afzelii
AKINTPASL

SEQ ID NO: 213811 - protein, 9 aa, Borrelia afzelii
KINTPASLS

SEQ ID NO: 213812 - protein, 9 aa, Borrelia afzelii
INTPASLSG

SEQ ID NO: 213813 - protein, 9 aa, Borrelia afzelii
NTPASLSGS

SEQ ID NO: 213814 - protein, 9 aa, Borrelia afzelii
TPASLSGSQ

SEQ ID NO: 213815 - protein, 9 aa, Borrelia afzelii
PASLSGSQA

SEQ ID NO: 213816 - protein, 9 aa, Borrelia afzelii
ASLSGSQAS

SEQ ID NO: 213817 - protein, 9 aa, Borrelia afzelii
SLSGSQASW

SEQ ID NO: 213818 - protein, 9 aa, Borrelia afzelii
LSGSQASWT

SEQ ID NO: 213819 - protein, 9 aa, Borrelia afzelii
SGSQASWTL

SEQ ID NO: 213820 - protein, 9 aa, Borrelia afzelii
GSQASWTLR

SEQ ID NO: 213821 - protein, 9 aa, Borrelia afzelii
SQASWTLRV

SEQ ID NO: 213822 - protein, 9 aa, Borrelia afzelii
QASWTLRVH

SEQ ID NO: 213823 - protein, 9 aa, Borrelia afzelii
ASWTLRVHV

SEQ ID NO: 213824 - protein, 9 aa, Borrelia afzelii
SWTLRVHVG

SEQ ID NO: 213825 - protein, 9 aa, Borrelia afzelii
WTLRVHVGA

SEQ ID NO: 213826 - protein, 9 aa, Borrelia afzelii
TLRVHVGAN

SEQ ID NO: 213827 - protein, 9 aa, Borrelia afzelii
LRVHVGANQ

SEQ ID NO: 213828 - protein, 9 aa, Borrelia afzelii
RVHVGANQD

SEQ ID NO: 213829 - protein, 9 aa, Borrelia afzelii
VHVGANQDE

SEQ ID NO: 213830 - protein, 9 aa, Borrelia afzelii
HVGANQDEA

SEQ ID NO: 213831 - protein, 9 aa, Borrelia afzelii
VGANQDEAI

SEQ ID NO: 213832 - protein, 9 aa, Borrelia afzelii
GANQDEAIA

SEQ ID NO: 213833 - protein, 9 aa, Borrelia afzelii
ANQDEAIAV

SEQ ID NO: 213834 - protein, 9 aa, Borrelia afzelii
NQDEAIAVN

SEQ ID NO: 213835 - protein, 9 aa, Borrelia afzelii
QDEAIAVNI

SEQ ID NO: 213836 - protein, 9 aa, Borrelia afzelii
DEAIAVNIY

SEQ ID NO: 213837 - protein, 9 aa, Borrelia afzelii
EAIAVNIYS

SEQ ID NO: 213838 - protein, 9 aa, Borrelia afzelii
AIAVNIYSA

SEQ ID NO: 213839 - protein, 9 aa, Borrelia afzelii
IAVNIYSAN

SEQ ID NO: 213840 - protein, 9 aa, Borrelia afzelii
AVNIYSANV

SEQ ID NO: 213841 - protein, 9 aa, Borrelia afzelii
VNIYSANVA

SEQ ID NO: 213842 - protein, 9 aa, Borrelia afzelii
NIYSANVAN

SEQ ID NO: 213843 - protein, 9 aa, Borrelia afzelii
IYSANVANL

SEQ ID NO: 213844 - protein, 9 aa, Borrelia afzelii
YSANVANLF

SEQ ID NO: 213845 - protein, 9 aa, Borrelia afzelii
SANVANLFA

SEQ ID NO: 213846 - protein, 9 aa, Borrelia afzelii
ANVANLFAG

SEQ ID NO: 213847 - protein, 9 aa, Borrelia afzelii
NVANLFAGE

SEQ ID NO: 213848 - protein, 9 aa, Borrelia afzelii
VANLFAGEG

SEQ ID NO: 213849 - protein, 9 aa, Borrelia afzelii
ANLFAGEGA

SEQ ID NO: 213850 - protein, 9 aa, Borrelia afzelii
NLFAGEGAQ

SEQ ID NO: 213851 - protein, 9 aa, Borrelia afzelii
LFAGEGAQA

SEQ ID NO: 213852 - protein, 9 aa, Borrelia afzelii
FAGEGAQAA

SEQ ID NO: 213853 - protein, 9 aa, Borrelia afzelii
AGEGAQAAQ

SEQ ID NO: 213854 - protein, 9 aa, Borrelia afzelii
GEGAQAAQA

SEQ ID NO: 213855 - protein, 9 aa, Borrelia afzelii
EGAQAAQAA

SEQ ID NO: 213856 - protein, 9 aa, Borrelia afzelii
GAQAAQAAP

SEQ ID NO: 213857 - protein, 9 aa, Borrelia afzelii
AQAAQAAPV

SEQ ID NO: 213858 - protein, 9 aa, Borrelia afzelii
QAAQAAPVQ

SEQ ID NO: 213859 - protein, 9 aa, Borrelia afzelii
AAQAAPVQE

SEQ ID NO: 213860 - protein, 9 aa, Borrelia afzelii
AQAAPVQEG

SEQ ID NO: 213861 - protein, 9 aa, Borrelia afzelii
QAAPVQEGA

SEQ ID NO: 213862 - protein, 9 aa, Borrelia afzelii
AAPVQEGAQ

SEQ ID NO: 213863 - protein, 9 aa, Borrelia afzelii
APVQEGAQE

SEQ ID NO: 213864 - protein, 9 aa, Borrelia afzelii
PVQEGAQEE

SEQ ID NO: 213865 - protein, 9 aa, Borrelia afzelii
VQEGAQEEG

SEQ ID NO: 213866 - protein, 9 aa, Borrelia afzelii
QEGAQEEGA

SEQ ID NO: 213867 - protein, 9 aa, Borrelia afzelii
EGAQEEGAQ

SEQ ID NO: 213868 - protein, 9 aa, Borrelia afzelii
GAQEEGAQQ

SEQ ID NO: 213869 - protein, 9 aa, Borrelia afzelii
AQEEGAQQP

SEQ ID NO: 213870 - protein, 9 aa, Borrelia afzelii
QEEGAQQPT

SEQ ID NO: 213871 - protein, 9 aa, Borrelia afzelii
EEGAQQPTP

SEQ ID NO: 213872 - protein, 9 aa, Borrelia afzelii
EGAQQPTPA

SEQ ID NO: 213873 - protein, 9 aa, Borrelia afzelii
GAQQPTPAT

SEQ ID NO: 213874 - protein, 9 aa, Borrelia afzelii
AQQPTPATA

SEQ ID NO: 213875 - protein, 9 aa, Borrelia afzelii
QQPTPATAP

SEQ ID NO: 213876 - protein, 9 aa, Borrelia afzelii
QPTPATAPT

SEQ ID NO: 213877 - protein, 9 aa, Borrelia afzelii
PTPATAPTQ

SEQ ID NO: 213878 - protein, 9 aa, Borrelia afzelii
TPATAPTQG

SEQ ID NO: 213879 - protein, 9 aa, Borrelia afzelii
PATAPTQGG

SEQ ID NO: 213880 - protein, 9 aa, Borrelia afzelii
ATAPTQGGV

SEQ ID NO: 213881 - protein, 9 aa, Borrelia afzelii
TAPTQGGVN

SEQ ID NO: 213882 - protein, 9 aa, Borrelia afzelii
APTQGGVNS

SEQ ID NO: 213883 - protein, 9 aa, Borrelia afzelii
PTQGGVNSP

SEQ ID NO: 213884 - protein, 9 aa, Borrelia afzelii
TQGGVNSPV

SEQ ID NO: 213885 - protein, 9 aa, Borrelia afzelii
QGGVNSPVN

SEQ ID NO: 213886 - protein, 9 aa, Borrelia afzelii
GGVNSPVNV

SEQ ID NO: 213887 - protein, 9 aa, Borrelia afzelii
GVNSPVNVT

SEQ ID NO: 213888 - protein, 9 aa, Borrelia afzelii
VNSPVNVTT

SEQ ID NO: 213889 - protein, 9 aa, Borrelia afzelii
NSPVNVTTT

SEQ ID NO: 213890 - protein, 9 aa, Borrelia afzelii
SPVNVTTTV

SEQ ID NO: 213891 - protein, 9 aa, Borrelia afzelii
PVNVTTTVD

SEQ ID NO: 213892 - protein, 9 aa, Borrelia afzelii
VNVTTTVDA

SEQ ID NO: 213893 - protein, 9 aa, Borrelia afzelii
NVTTTVDAN

SEQ ID NO: 213894 - protein, 9 aa, Borrelia afzelii
VTTTVDANT

SEQ ID NO: 213895 - protein, 9 aa, Borrelia afzelii
TTTVDANTS

SEQ ID NO: 213896 - protein, 9 aa, Borrelia afzelii
TTVDANTSL

SEQ ID NO: 213897 - protein, 9 aa, Borrelia afzelii
TVDANTSLA

SEQ ID NO: 213898 - protein, 9 aa, Borrelia afzelii
VDANTSLAK

SEQ ID NO: 213899 - protein, 9 aa, Borrelia afzelii
DANTSLAKI

SEQ ID NO: 213900 - protein, 9 aa, Borrelia afzelii
ANTSLAKIE

SEQ ID NO: 213901 - protein, 9 aa, Borrelia afzelii
NTSLAKIEN

SEQ ID NO: 213902 - protein, 9 aa, Borrelia afzelii
TSLAKIENA

SEQ ID NO: 213903 - protein, 9 aa, Borrelia afzelii
SLAKIENAI

SEQ ID NO: 213904 - protein, 9 aa, Borrelia afzelii
LAKIENAIR

SEQ ID NO: 213905 - protein, 9 aa, Borrelia afzelii
AKIENAIRM

SEQ ID NO: 213906 - protein, 9 aa, Borrelia afzelii
KIENAIRMI

SEQ ID NO: 213907 - protein, 9 aa, Borrelia afzelii
IENAIRMIS

SEQ ID NO: 213908 - protein, 9 aa, Borrelia afzelii
ENAIRMISD

SEQ ID NO: 213909 - protein, 9 aa, Borrelia afzelii
NAIRMISDQ

SEQ ID NO: 213910 - protein, 9 aa, Borrelia afzelii
AIRMISDQR

SEQ ID NO: 213911 - protein, 9 aa, Borrelia afzelii
IRMISDQRA

SEQ ID NO: 213912 - protein, 9 aa, Borrelia afzelii
RMISDQRAN

SEQ ID NO: 213913 - protein, 9 aa, Borrelia afzelii
MISDQRANL

SEQ ID NO: 213914 - protein, 9 aa, Borrelia afzelii
ISDQRANLG

SEQ ID NO: 213915 - protein, 9 aa, Borrelia afzelii
SDQRANLGA

SEQ ID NO: 213916 - protein, 9 aa, Borrelia afzelii
DQRANLGAF

SEQ ID NO: 213917 - protein, 9 aa, Borrelia afzelii
QRANLGAFQ

SEQ ID NO: 213918 - protein, 9 aa, Borrelia afzelii
RANLGAFQN

SEQ ID NO: 213919 - protein, 9 aa, Borrelia afzelii
ANLGAFQNR

SEQ ID NO: 213920 - protein, 9 aa, Borrelia afzelii
NLGAFQNRL

SEQ ID NO: 213921 - protein, 9 aa, Borrelia afzelii
LGAFQNRLE

SEQ ID NO: 213922 - protein, 9 aa, Borrelia afzelii
GAFQNRLES

SEQ ID NO: 213923 - protein, 9 aa, Borrelia afzelii
AFQNRLESI

SEQ ID NO: 213924 - protein, 9 aa, Borrelia afzelii
FQNRLESIK

SEQ ID NO: 213925 - protein, 9 aa, Borrelia afzelii
QNRLESIKN

SEQ ID NO: 213926 - protein, 9 aa, Borrelia afzelii
NRLESIKNS

SEQ ID NO: 213927 - protein, 9 aa, Borrelia afzelii
RLESIKNST

SEQ ID NO: 213928 - protein, 9 aa, Borrelia afzelii
LESIKNSTE

SEQ ID NO: 213929 - protein, 9 aa, Borrelia afzelii
ESIKNSTEY

SEQ ID NO: 213930 - protein, 9 aa, Borrelia afzelii
SIKNSTEYA

SEQ ID NO: 213931 - protein, 9 aa, Borrelia afzelii
IKNSTEYAI

SEQ ID NO: 213932 - protein, 9 aa, Borrelia afzelii
KNSTEYAIE

SEQ ID NO: 213933 - protein, 9 aa, Borrelia afzelii
NSTEYAIEN

SEQ ID NO: 213934 - protein, 9 aa, Borrelia afzelii
STEYAIENL

SEQ ID NO: 213935 - protein, 9 aa, Borrelia afzelii
TEYAIENLK

SEQ ID NO: 213936 - protein, 9 aa, Borrelia afzelii
EYAIENLKA

SEQ ID NO: 213937 - protein, 9 aa, Borrelia afzelii
YAIENLKAS

SEQ ID NO: 213938 - protein, 9 aa, Borrelia afzelii
AIENLKASY

SEQ ID NO: 213939 - protein, 9 aa, Borrelia afzelii
IENLKASYA

SEQ ID NO: 213940 - protein, 9 aa, Borrelia afzelii
ENLKASYAQ

SEQ ID NO: 213941 - protein, 9 aa, Borrelia afzelii
NLKASYAQI

SEQ ID NO: 213942 - protein, 9 aa, Borrelia afzelii
LKASYAQIK

SEQ ID NO: 213943 - protein, 9 aa, Borrelia afzelii
KASYAQIKD

SEQ ID NO: 213944 - protein, 9 aa, Borrelia afzelii
ASYAQIKDA

SEQ ID NO: 213945 - protein, 9 aa, Borrelia afzelii
SYAQIKDAT

SEQ ID NO: 213946 - protein, 9 aa, Borrelia afzelii
YAQIKDATM

SEQ ID NO: 213947 - protein, 9 aa, Borrelia afzelii
AQIKDATMT

SEQ ID NO: 213948 - protein, 9 aa, Borrelia afzelii
QIKDATMTD

SEQ ID NO: 213949 - protein, 9 aa, Borrelia afzelii
IKDATMTDE

SEQ ID NO: 213950 - protein, 9 aa, Borrelia afzelii
KDATMTDEV

SEQ ID NO: 213951 - protein, 9 aa, Borrelia afzelii
DATMTDEVV

SEQ ID NO: 213952 - protein, 9 aa, Borrelia afzelii
ATMTDEVVA

SEQ ID NO: 213953 - protein, 9 aa, Borrelia afzelii
TMTDEVVAA

SEQ ID NO: 213954 - protein, 9 aa, Borrelia afzelii
MTDEVVAAT

SEQ ID NO: 213955 - protein, 9 aa, Borrelia afzelii
TDEVVAATT

SEQ ID NO: 213956 - protein, 9 aa, Borrelia afzelii
DEVVAATTN

SEQ ID NO: 213957 - protein, 9 aa, Borrelia afzelii
EVVAATTNS

SEQ ID NO: 213958 - protein, 9 aa, Borrelia afzelii
VVAATTNSI

SEQ ID NO: 213959 - protein, 9 aa, Borrelia afzelii
VAATTNSIL

SEQ ID NO: 213960 - protein, 9 aa, Borrelia afzelii
AATTNSILT

SEQ ID NO: 213961 - protein, 9 aa, Borrelia afzelii
ATTNSILTQ

SEQ ID NO: 213962 - protein, 9 aa, Borrelia afzelii
TTNSILTQS

SEQ ID NO: 213963 - protein, 9 aa, Borrelia afzelii
TNSILTQSA

SEQ ID NO: 213964 - protein, 9 aa, Borrelia afzelii
NSILTQSAM

SEQ ID NO: 213965 - protein, 9 aa, Borrelia afzelii
SILTQSAMA

SEQ ID NO: 213966 - protein, 9 aa, Borrelia afzelii
ILTQSAMAM

SEQ ID NO: 213967 - protein, 9 aa, Borrelia afzelii
LTQSAMAMI

SEQ ID NO: 213968 - protein, 9 aa, Borrelia afzelii
TQSAMAMIA

SEQ ID NO: 213969 - protein, 9 aa, Borrelia afzelii
QSAMAMIAQ

SEQ ID NO: 213970 - protein, 9 aa, Borrelia afzelii
SAMAMIAQA

SEQ ID NO: 213971 - protein, 9 aa, Borrelia afzelii
AMAMIAQAN

SEQ ID NO: 213972 - protein, 9 aa, Borrelia afzelii
MAMIAQANQ

SEQ ID NO: 213973 - protein, 9 aa, Borrelia afzelii
AMIAQANQV

SEQ ID NO: 213974 - protein, 9 aa, Borrelia afzelii
MIAQANQVP

SEQ ID NO: 213975 - protein, 9 aa, Borrelia afzelii
IAQANQVPQ

SEQ ID NO: 213976 - protein, 9 aa, Borrelia afzelii
AQANQVPQY

SEQ ID NO: 213977 - protein, 9 aa, Borrelia afzelii
QANQVPQYV

SEQ ID NO: 213978 - protein, 9 aa, Borrelia afzelii
ANQVPQYVL

SEQ ID NO: 213979 - protein, 9 aa, Borrelia afzelii
NQVPQYVLS

SEQ ID NO: 213980 - protein, 9 aa, Borrelia afzelii
QVPQYVLSL

SEQ ID NO: 213981 - protein, 9 aa, Borrelia afzelii
VPQYVLSLL

SEQ ID NO: 213982 - protein, 9 aa, Borrelia afzelii
PQYVLSLLR

SEQ ID NO: 213983 - protein, 10 aa, Borrelia afzelii
MIINHNTSAI

SEQ ID NO: 213984 - protein, 10 aa, Borrelia afzelii
IINHNTSAIN

SEQ ID NO: 213985 - protein, 10 aa, Borrelia afzelii
INHNTSAINA

SEQ ID NO: 213986 - protein, 10 aa, Borrelia afzelii
NHNTSAINAS

SEQ ID NO: 213987 - protein, 10 aa, Borrelia afzelii
HNTSAINASR

SEQ ID NO: 213988 - protein, 10 aa, Borrelia afzelii
NTSAINASRN

SEQ ID NO: 213989 - protein, 10 aa, Borrelia afzelii
TSAINASRNN

SEQ ID NO: 213990 - protein, 10 aa, Borrelia afzelii
SAINASRNNA

SEQ ID NO: 213991 - protein, 10 aa, Borrelia afzelii
AINASRNNAI

SEQ ID NO: 213992 - protein, 10 aa, Borrelia afzelii
INASRNNAIN

SEQ ID NO: 213993 - protein, 10 aa, Borrelia afzelii
NASRNNAINA

SEQ ID NO: 213994 - protein, 10 aa, Borrelia afzelii
ASRNNAINAA

SEQ ID NO: 213995 - protein, 10 aa, Borrelia afzelii
SRNNAINAAN

SEQ ID NO: 213996 - protein, 10 aa, Borrelia afzelii
RNNAINAANL

SEQ ID NO: 213997 - protein, 10 aa, Borrelia afzelii
NNAINAANLS

SEQ ID NO: 213998 - protein, 10 aa, Borrelia afzelii
NAINAANLSK

SEQ ID NO: 213999 - protein, 10 aa, Borrelia afzelii
AINAANLSKT

SEQ ID NO: 214000 - protein, 10 aa, Borrelia afzelii
INAANLSKTQ

SEQ ID NO: 214001 - protein, 10 aa, Borrelia afzelii
NAANLSKTQE

SEQ ID NO: 214002 - protein, 10 aa, Borrelia afzelii
AANLSKTQEK

SEQ ID NO: 214003 - protein, 10 aa, Borrelia afzelii
ANLSKTQEKL

SEQ ID NO: 214004 - protein, 10 aa, Borrelia afzelii
NLSKTQEKLS

SEQ ID NO: 214005 - protein, 10 aa, Borrelia afzelii
LSKTQEKLSS

SEQ ID NO: 214006 - protein, 10 aa, Borrelia afzelii
SKTQEKLSSG

SEQ ID NO: 214007 - protein, 10 aa, Borrelia afzelii
KTQEKLSSGY

SEQ ID NO: 214008 - protein, 10 aa, Borrelia afzelii
TQEKLSSGYR

SEQ ID NO: 214009 - protein, 10 aa, Borrelia afzelii
QEKLSSGYRI

SEQ ID NO: 214010 - protein, 10 aa, Borrelia afzelii
EKLSSGYRIN

SEQ ID NO: 214011 - protein, 10 aa, Borrelia afzelii
KLSSGYRINR

SEQ ID NO: 214012 - protein, 10 aa, Borrelia afzelii
LSSGYRINRA

SEQ ID NO: 214013 - protein, 10 aa, Borrelia afzelii
SSGYRINRAS

SEQ ID NO: 214014 - protein, 10 aa, Borrelia afzelii
SGYRINRASD

SEQ ID NO: 214015 - protein, 10 aa, Borrelia afzelii
GYRINRASDD

SEQ ID NO: 214016 - protein, 10 aa, Borrelia afzelii
YRINRASDDA

SEQ ID NO: 214017 - protein, 10 aa, Borrelia afzelii
RINRASDDAA

SEQ ID NO: 214018 - protein, 10 aa, Borrelia afzelii
INRASDDAAG

SEQ ID NO: 214019 - protein, 10 aa, Borrelia afzelii
NRASDDAAGM

SEQ ID NO: 214020 - protein, 10 aa, Borrelia afzelii
RASDDAAGMG

SEQ ID NO: 214021 - protein, 10 aa, Borrelia afzelii
ASDDAAGMGV

SEQ ID NO: 214022 - protein, 10 aa, Borrelia afzelii
SDDAAGMGVS

SEQ ID NO: 214023 - protein, 10 aa, Borrelia afzelii
DDAAGMGVSG

SEQ ID NO: 214024 - protein, 10 aa, Borrelia afzelii
DAAGMGVSGK

SEQ ID NO: 214025 - protein, 10 aa, Borrelia afzelii
AAGMGVSGKI

SEQ ID NO: 214026 - protein, 10 aa, Borrelia afzelii
AGMGVSGKIN

SEQ ID NO: 214027 - protein, 10 aa, Borrelia afzelii
GMGVSGKINA

SEQ ID NO: 214028 - protein, 10 aa, Borrelia afzelii
MGVSGKINAQ

SEQ ID NO: 214029 - protein, 10 aa, Borrelia afzelii
GVSGKINAQI

SEQ ID NO: 214030 - protein, 10 aa, Borrelia afzelii
VSGKINAQIR

SEQ ID NO: 214031 - protein, 10 aa, Borrelia afzelii
SGKINAQIRG

SEQ ID NO: 214032 - protein, 10 aa, Borrelia afzelii
GKINAQIRGL

SEQ ID NO: 214033 - protein, 10 aa, Borrelia afzelii
KINAQIRGLS

SEQ ID NO: 214034 - protein, 10 aa, Borrelia afzelii
INAQIRGLSQ

SEQ ID NO: 214035 - protein, 10 aa, Borrelia afzelii
NAQIRGLSQA

SEQ ID NO: 214036 - protein, 10 aa, Borrelia afzelii
AQIRGLSQAS

SEQ ID NO: 214037 - protein, 10 aa, Borrelia afzelii
QIRGLSQASR

SEQ ID NO: 214038 - protein, 10 aa, Borrelia afzelii
IRGLSQASRN

SEQ ID NO: 214039 - protein, 10 aa, Borrelia afzelii
RGLSQASRNT

SEQ ID NO: 214040 - protein, 10 aa, Borrelia afzelii
GLSQASRNTS

SEQ ID NO: 214041 - protein, 10 aa, Borrelia afzelii
LSQASRNTSK

SEQ ID NO: 214042 - protein, 10 aa, Borrelia afzelii
SQASRNTSKA

SEQ ID NO: 214043 - protein, 10 aa, Borrelia afzelii
QASRNTSKAI

SEQ ID NO: 214044 - protein, 10 aa, Borrelia afzelii
ASRNTSKAIN

SEQ ID NO: 214045 - protein, 10 aa, Borrelia afzelii
SRNTSKAINF

SEQ ID NO: 214046 - protein, 10 aa, Borrelia afzelii
RNTSKAINFI

SEQ ID NO: 214047 - protein, 10 aa, Borrelia afzelii
NTSKAINFIQ

SEQ ID NO: 214048 - protein, 10 aa, Borrelia afzelii
TSKAINFIQT

SEQ ID NO: 214049 - protein, 10 aa, Borrelia afzelii
SKAINFIQTT

SEQ ID NO: 214050 - protein, 10 aa, Borrelia afzelii
KAINFIQTTE

SEQ ID NO: 214051 - protein, 10 aa, Borrelia afzelii
AINFIQTTEG

SEQ ID NO: 214052 - protein, 10 aa, Borrelia afzelii
INFIQTTEGN

SEQ ID NO: 214053 - protein, 10 aa, Borrelia afzelii
NFIQTTEGNL

SEQ ID NO: 214054 - protein, 10 aa, Borrelia afzelii
FIQTTEGNLN

SEQ ID NO: 214055 - protein, 10 aa, Borrelia afzelii
IQTTEGNLNE

SEQ ID NO: 214056 - protein, 10 aa, Borrelia afzelii
QTTEGNLNEV

SEQ ID NO: 214057 - protein, 10 aa, Borrelia afzelii
TTEGNLNEVE

SEQ ID NO: 214058 - protein, 10 aa, Borrelia afzelii
TEGNLNEVEK

SEQ ID NO: 214059 - protein, 10 aa, Borrelia afzelii
EGNLNEVEKV

SEQ ID NO: 214060 - protein, 10 aa, Borrelia afzelii
GNLNEVEKVL

SEQ ID NO: 214061 - protein, 10 aa, Borrelia afzelii
NLNEVEKVLV

SEQ ID NO: 214062 - protein, 10 aa, Borrelia afzelii
LNEVEKVLVR

SEQ ID NO: 214063 - protein, 10 aa, Borrelia afzelii
NEVEKVLVRM

SEQ ID NO: 214064 - protein, 10 aa, Borrelia afzelii
EVEKVLVRMK

SEQ ID NO: 214065 - protein, 10 aa, Borrelia afzelii
VEKVLVRMKE

SEQ ID NO: 214066 - protein, 10 aa, Borrelia afzelii
EKVLVRMKEL

SEQ ID NO: 214067 - protein, 10 aa, Borrelia afzelii
KVLVRMKELA

SEQ ID NO: 214068 - protein, 10 aa, Borrelia afzelii
VLVRMKELAV

SEQ ID NO: 214069 - protein, 10 aa, Borrelia afzelii
LVRMKELAVQ

SEQ ID NO: 214070 - protein, 10 aa, Borrelia afzelii
VRMKELAVQS

SEQ ID NO: 214071 - protein, 10 aa, Borrelia afzelii
RMKELAVQSG

SEQ ID NO: 214072 - protein, 10 aa, Borrelia afzelii
MKELAVQSGN

SEQ ID NO: 214073 - protein, 10 aa, Borrelia afzelii
KELAVQSGNG

SEQ ID NO: 214074 - protein, 10 aa, Borrelia afzelii
ELAVQSGNGT

SEQ ID NO: 214075 - protein, 10 aa, Borrelia afzelii
LAVQSGNGTY

SEQ ID NO: 214076 - protein, 10 aa, Borrelia afzelii
AVQSGNGTYS

SEQ ID NO: 214077 - protein, 10 aa, Borrelia afzelii
VQSGNGTYSD

SEQ ID NO: 214078 - protein, 10 aa, Borrelia afzelii
QSGNGTYSDS

SEQ ID NO: 214079 - protein, 10 aa, Borrelia afzelii
SGNGTYSDSD

SEQ ID NO: 214080 - protein, 10 aa, Borrelia afzelii
GNGTYSDSDR

SEQ ID NO: 214081 - protein, 10 aa, Borrelia afzelii
NGTYSDSDRG

SEQ ID NO: 214082 - protein, 10 aa, Borrelia afzelii
GTYSDSDRGS

SEQ ID NO: 214083 - protein, 10 aa, Borrelia afzelii
TYSDSDRGSI

SEQ ID NO: 214084 - protein, 10 aa, Borrelia afzelii
YSDSDRGSIQ

SEQ ID NO: 214085 - protein, 10 aa, Borrelia afzelii
SDSDRGSIQI

SEQ ID NO: 214086 - protein, 10 aa, Borrelia afzelii
DSDRGSIQIE

SEQ ID NO: 214087 - protein, 10 aa, Borrelia afzelii
SDRGSIQIEI

SEQ ID NO: 214088 - protein, 10 aa, Borrelia afzelii
DRGSIQIEIE

SEQ ID NO: 214089 - protein, 10 aa, Borrelia afzelii
RGSIQIEIEQ

SEQ ID NO: 214090 - protein, 10 aa, Borrelia afzelii
GSIQIEIEQL

SEQ ID NO: 214091 - protein, 10 aa, Borrelia afzelii
SIQIEIEQLT

SEQ ID NO: 214092 - protein, 10 aa, Borrelia afzelii
IQIEIEQLTD

SEQ ID NO: 214093 - protein, 10 aa, Borrelia afzelii
QIEIEQLTDE

SEQ ID NO: 214094 - protein, 10 aa, Borrelia afzelii
IEIEQLTDEI

SEQ ID NO: 214095 - protein, 10 aa, Borrelia afzelii
EIEQLTDEIN

SEQ ID NO: 214096 - protein, 10 aa, Borrelia afzelii
IEQLTDEINR

SEQ ID NO: 214097 - protein, 10 aa, Borrelia afzelii
EQLTDEINRI

SEQ ID NO: 214098 - protein, 10 aa, Borrelia afzelii
QLTDEINRIA

SEQ ID NO: 214099 - protein, 10 aa, Borrelia afzelii
LTDEINRIAD

SEQ ID NO: 214100 - protein, 10 aa, Borrelia afzelii
TDEINRIADQ

SEQ ID NO: 214101 - protein, 10 aa, Borrelia afzelii
DEINRIADQA

SEQ ID NO: 214102 - protein, 10 aa, Borrelia afzelii
EINRIADQAQ

SEQ ID NO: 214103 - protein, 10 aa, Borrelia afzelii
INRIADQAQY

SEQ ID NO: 214104 - protein, 10 aa, Borrelia afzelii
NRIADQAQYN

SEQ ID NO: 214105 - protein, 10 aa, Borrelia afzelii
RIADQAQYNQ

SEQ ID NO: 214106 - protein, 10 aa, Borrelia afzelii
IADQAQYNQM

SEQ ID NO: 214107 - protein, 10 aa, Borrelia afzelii
ADQAQYNQMH

SEQ ID NO: 214108 - protein, 10 aa, Borrelia afzelii
DQAQYNQMHM

SEQ ID NO: 214109 - protein, 10 aa, Borrelia afzelii
QAQYNQMHML

SEQ ID NO: 214110 - protein, 10 aa, Borrelia afzelii
AQYNQMHMLS

SEQ ID NO: 214111 - protein, 10 aa, Borrelia afzelii
QYNQMHMLSN

SEQ ID NO: 214112 - protein, 10 aa, Borrelia afzelii
YNQMHMLSNK

SEQ ID NO: 214113 - protein, 10 aa, Borrelia afzelii
NQMHMLSNKS

SEQ ID NO: 214114 - protein, 10 aa, Borrelia afzelii
QMHMLSNKSA

SEQ ID NO: 214115 - protein, 10 aa, Borrelia afzelii
MHMLSNKSAS

SEQ ID NO: 214116 - protein, 10 aa, Borrelia afzelii
HMLSNKSASQ

SEQ ID NO: 214117 - protein, 10 aa, Borrelia afzelii
MLSNKSASQN

SEQ ID NO: 214118 - protein, 10 aa, Borrelia afzelii
LSNKSASQNV

SEQ ID NO: 214119 - protein, 10 aa, Borrelia afzelii
SNKSASQNVK

SEQ ID NO: 214120 - protein, 10 aa, Borrelia afzelii
NKSASQNVKT

SEQ ID NO: 214121 - protein, 10 aa, Borrelia afzelii
KSASQNVKTA

SEQ ID NO: 214122 - protein, 10 aa, Borrelia afzelii
SASQNVKTAE

SEQ ID NO: 214123 - protein, 10 aa, Borrelia afzelii
ASQNVKTAEE

SEQ ID NO: 214124 - protein, 10 aa, Borrelia afzelii
SQNVKTAEEL

SEQ ID NO: 214125 - protein, 10 aa, Borrelia afzelii
QNVKTAEELG

SEQ ID NO: 214126 - protein, 10 aa, Borrelia afzelii
NVKTAEELGM

SEQ ID NO: 214127 - protein, 10 aa, Borrelia afzelii
VKTAEELGMQ

SEQ ID NO: 214128 - protein, 10 aa, Borrelia afzelii
KTAEELGMQP

SEQ ID NO: 214129 - protein, 10 aa, Borrelia afzelii
TAEELGMQPA

SEQ ID NO: 214130 - protein, 10 aa, Borrelia afzelii
AEELGMQPAK

SEQ ID NO: 214131 - protein, 10 aa, Borrelia afzelii
EELGMQPAKI

SEQ ID NO: 214132 - protein, 10 aa, Borrelia afzelii
ELGMQPAKIN

SEQ ID NO: 214133 - protein, 10 aa, Borrelia afzelii
LGMQPAKINT

SEQ ID NO: 214134 - protein, 10 aa, Borrelia afzelii
GMQPAKINTP

SEQ ID NO: 214135 - protein, 10 aa, Borrelia afzelii
MQPAKINTPA

SEQ ID NO: 214136 - protein, 10 aa, Borrelia afzelii
QPAKINTPAS

SEQ ID NO: 214137 - protein, 10 aa, Borrelia afzelii
PAKINTPASL

SEQ ID NO: 214138 - protein, 10 aa, Borrelia afzelii
AKINTPASLS

SEQ ID NO: 214139 - protein, 10 aa, Borrelia afzelii
KINTPASLSG

SEQ ID NO: 214140 - protein, 10 aa, Borrelia afzelii
INTPASLSGS

SEQ ID NO: 214141 - protein, 10 aa, Borrelia afzelii
NTPASLSGSQ

SEQ ID NO: 214142 - protein, 10 aa, Borrelia afzelii
TPASLSGSQA

SEQ ID NO: 214143 - protein, 10 aa, Borrelia afzelii
PASLSGSQAS

SEQ ID NO: 214144 - protein, 10 aa, Borrelia afzelii
ASLSGSQASW

SEQ ID NO: 214145 - protein, 10 aa, Borrelia afzelii
SLSGSQASWT

SEQ ID NO: 214146 - protein, 10 aa, Borrelia afzelii
LSGSQASWTL

SEQ ID NO: 214147 - protein, 10 aa, Borrelia afzelii
SGSQASWTLR

SEQ ID NO: 214148 - protein, 10 aa, Borrelia afzelii
GSQASWTLRV

SEQ ID NO: 214149 - protein, 10 aa, Borrelia afzelii
SQASWTLRVH

SEQ ID NO: 214150 - protein, 10 aa, Borrelia afzelii
QASWTLRVHV

SEQ ID NO: 214151 - protein, 10 aa, Borrelia afzelii
ASWTLRVHVG

SEQ ID NO: 214152 - protein, 10 aa, Borrelia afzelii
SWTLRVHVGA

SEQ ID NO: 214153 - protein, 10 aa, Borrelia afzelii
WTLRVHVGAN

SEQ ID NO: 214154 - protein, 10 aa, Borrelia afzelii
TLRVHVGANQ

SEQ ID NO: 214155 - protein, 10 aa, Borrelia afzelii
LRVHVGANQD

SEQ ID NO: 214156 - protein, 10 aa, Borrelia afzelii
RVHVGANQDE

SEQ ID NO: 214157 - protein, 10 aa, Borrelia afzelii
VHVGANQDEA

SEQ ID NO: 214158 - protein, 10 aa, Borrelia afzelii
HVGANQDEAI

SEQ ID NO: 214159 - protein, 10 aa, Borrelia afzelii
VGANQDEAIA

SEQ ID NO: 214160 - protein, 10 aa, Borrelia afzelii
GANQDEAIAV

SEQ ID NO: 214161 - protein, 10 aa, Borrelia afzelii
ANQDEAIAVN

SEQ ID NO: 214162 - protein, 10 aa, Borrelia afzelii
NQDEAIAVNI

SEQ ID NO: 214163 - protein, 10 aa, Borrelia afzelii
QDEAIAVNIY

SEQ ID NO: 214164 - protein, 10 aa, Borrelia afzelii
DEAIAVNIYS

SEQ ID NO: 214165 - protein, 10 aa, Borrelia afzelii
EAIAVNIYSA

SEQ ID NO: 214166 - protein, 10 aa, Borrelia afzelii
AIAVNIYSAN

SEQ ID NO: 214167 - protein, 10 aa, Borrelia afzelii
IAVNIYSANV

SEQ ID NO: 214168 - protein, 10 aa, Borrelia afzelii
AVNIYSANVA

SEQ ID NO: 214169 - protein, 10 aa, Borrelia afzelii
VNIYSANVAN

SEQ ID NO: 214170 - protein, 10 aa, Borrelia afzelii
NIYSANVANL

SEQ ID NO: 214171 - protein, 10 aa, Borrelia afzelii
IYSANVANLF

SEQ ID NO: 214172 - protein, 10 aa, Borrelia afzelii
YSANVANLFA

SEQ ID NO: 214173 - protein, 10 aa, Borrelia afzelii
SANVANLFAG

SEQ ID NO: 214174 - protein, 10 aa, Borrelia afzelii
ANVANLFAGE

SEQ ID NO: 214175 - protein, 10 aa, Borrelia afzelii
NVANLFAGEG

SEQ ID NO: 214176 - protein, 10 aa, Borrelia afzelii
VANLFAGEGA

SEQ ID NO: 214177 - protein, 10 aa, Borrelia afzelii
ANLFAGEGAQ

SEQ ID NO: 214178 - protein, 10 aa, Borrelia afzelii
NLFAGEGAQA

SEQ ID NO: 214179 - protein, 10 aa, Borrelia afzelii
LFAGEGAQAA

SEQ ID NO: 214180 - protein, 10 aa, Borrelia afzelii
FAGEGAQAAQ

SEQ ID NO: 214181 - protein, 10 aa, Borrelia afzelii
AGEGAQAAQA

SEQ ID NO: 214182 - protein, 10 aa, Borrelia afzelii
GEGAQAAQAA

SEQ ID NO: 214183 - protein, 10 aa, Borrelia afzelii
EGAQAAQAAP

SEQ ID NO: 214184 - protein, 10 aa, Borrelia afzelii
GAQAAQAAPV

SEQ ID NO: 214185 - protein, 10 aa, Borrelia afzelii
AQAAQAAPVQ

SEQ ID NO: 214186 - protein, 10 aa, Borrelia afzelii
QAAQAAPVQE

SEQ ID NO: 214187 - protein, 10 aa, Borrelia afzelii
AAQAAPVQEG

SEQ ID NO: 214188 - protein, 10 aa, Borrelia afzelii
AQAAPVQEGA

SEQ ID NO: 214189 - protein, 10 aa, Borrelia afzelii
QAAPVQEGAQ

SEQ ID NO: 214190 - protein, 10 aa, Borrelia afzelii
AAPVQEGAQE

SEQ ID NO: 214191 - protein, 10 aa, Borrelia afzelii
APVQEGAQEE

SEQ ID NO: 214192 - protein, 10 aa, Borrelia afzelii
PVQEGAQEEG

SEQ ID NO: 214193 - protein, 10 aa, Borrelia afzelii
VQEGAQEEGA

SEQ ID NO: 214194 - protein, 10 aa, Borrelia afzelii
QEGAQEEGAQ

SEQ ID NO: 214195 - protein, 10 aa, Borrelia afzelii
EGAQEEGAQQ

SEQ ID NO: 214196 - protein, 10 aa, Borrelia afzelii
GAQEEGAQQP

SEQ ID NO: 214197 - protein, 10 aa, Borrelia afzelii
AQEEGAQQPT

SEQ ID NO: 214198 - protein, 10 aa, Borrelia afzelii
QEEGAQQPTP

SEQ ID NO: 214199 - protein, 10 aa, Borrelia afzelii
EEGAQQPTPA

SEQ ID NO: 214200 - protein, 10 aa, Borrelia afzelii
EGAQQPTPAT

SEQ ID NO: 214201 - protein, 10 aa, Borrelia afzelii
GAQQPTPATA

SEQ ID NO: 214202 - protein, 10 aa, Borrelia afzelii
AQQPTPATAP

SEQ ID NO: 214203 - protein, 10 aa, Borrelia afzelii
QQPTPATAPT

SEQ ID NO: 214204 - protein, 10 aa, Borrelia afzelii
QPTPATAPTQ

SEQ ID NO: 214205 - protein, 10 aa, Borrelia afzelii
PTPATAPTQG

SEQ ID NO: 214206 - protein, 10 aa, Borrelia afzelii
TPATAPTQGG

SEQ ID NO: 214207 - protein, 10 aa, Borrelia afzelii
PATAPTQGGV

SEQ ID NO: 214208 - protein, 10 aa, Borrelia afzelii
ATAPTQGGVN

SEQ ID NO: 214209 - protein, 10 aa, Borrelia afzelii
TAPTQGGVNS

SEQ ID NO: 214210 - protein, 10 aa, Borrelia afzelii
APTQGGVNSP

SEQ ID NO: 214211 - protein, 10 aa, Borrelia afzelii
PTQGGVNSPV

SEQ ID NO: 214212 - protein, 10 aa, Borrelia afzelii
TQGGVNSPVN

SEQ ID NO: 214213 - protein, 10 aa, Borrelia afzelii
QGGVNSPVNV

SEQ ID NO: 214214 - protein, 10 aa, Borrelia afzelii
GGVNSPVNVT

SEQ ID NO: 214215 - protein, 10 aa, Borrelia afzelii
GVNSPVNVTT

SEQ ID NO: 214216 - protein, 10 aa, Borrelia afzelii
VNSPVNVTTT

SEQ ID NO: 214217 - protein, 10 aa, Borrelia afzelii
NSPVNVTTTV

SEQ ID NO: 214218 - protein, 10 aa, Borrelia afzelii
SPVNVTTTVD

SEQ ID NO: 214219 - protein, 10 aa, Borrelia afzelii
PVNVTTTVDA

SEQ ID NO: 214220 - protein, 10 aa, Borrelia afzelii
VNVTTTVDAN

SEQ ID NO: 214221 - protein, 10 aa, Borrelia afzelii
NVTTTVDANT

SEQ ID NO: 214222 - protein, 10 aa, Borrelia afzelii
VTTTVDANTS

SEQ ID NO: 214223 - protein, 10 aa, Borrelia afzelii
TTTVDANTSL

SEQ ID NO: 214224 - protein, 10 aa, Borrelia afzelii
TTVDANTSLA

SEQ ID NO: 214225 - protein, 10 aa, Borrelia afzelii
TVDANTSLAK

SEQ ID NO: 214226 - protein, 10 aa, Borrelia afzelii
VDANTSLAKI

SEQ ID NO: 214227 - protein, 10 aa, Borrelia afzelii
DANTSLAKIE

SEQ ID NO: 214228 - protein, 10 aa, Borrelia afzelii
ANTSLAKIEN

SEQ ID NO: 214229 - protein, 10 aa, Borrelia afzelii
NTSLAKIENA

SEQ ID NO: 214230 - protein, 10 aa, Borrelia afzelii
TSLAKIENAI

SEQ ID NO: 214231 - protein, 10 aa, Borrelia afzelii
SLAKIENAIR

SEQ ID NO: 214232 - protein, 10 aa, Borrelia afzelii
LAKIENAIRM

SEQ ID NO: 214233 - protein, 10 aa, Borrelia afzelii
AKIENAIRMI

SEQ ID NO: 214234 - protein, 10 aa, Borrelia afzelii
KIENAIRMIS

SEQ ID NO: 214235 - protein, 10 aa, Borrelia afzelii
IENAIRMISD

SEQ ID NO: 214236 - protein, 10 aa, Borrelia afzelii
ENAIRMISDQ

SEQ ID NO: 214237 - protein, 10 aa, Borrelia afzelii
NAIRMISDQR

SEQ ID NO: 214238 - protein, 10 aa, Borrelia afzelii
AIRMISDQRA

SEQ ID NO: 214239 - protein, 10 aa, Borrelia afzelii
IRMISDQRAN

SEQ ID NO: 214240 - protein, 10 aa, Borrelia afzelii
RMISDQRANL

SEQ ID NO: 214241 - protein, 10 aa, Borrelia afzelii
MISDQRANLG

SEQ ID NO: 214242 - protein, 10 aa, Borrelia afzelii
ISDQRANLGA

SEQ ID NO: 214243 - protein, 10 aa, Borrelia afzelii
SDQRANLGAF

SEQ ID NO: 214244 - protein, 10 aa, Borrelia afzelii
DQRANLGAFQ

SEQ ID NO: 214245 - protein, 10 aa, Borrelia afzelii
QRANLGAFQN

SEQ ID NO: 214246 - protein, 10 aa, Borrelia afzelii
RANLGAFQNR

SEQ ID NO: 214247 - protein, 10 aa, Borrelia afzelii
ANLGAFQNRL

SEQ ID NO: 214248 - protein, 10 aa, Borrelia afzelii
NLGAFQNRLE

SEQ ID NO: 214249 - protein, 10 aa, Borrelia afzelii
LGAFQNRLES

SEQ ID NO: 214250 - protein, 10 aa, Borrelia afzelii
GAFQNRLESI

SEQ ID NO: 214251 - protein, 10 aa, Borrelia afzelii
AFQNRLESIK

SEQ ID NO: 214252 - protein, 10 aa, Borrelia afzelii
FQNRLESIKN

SEQ ID NO: 214253 - protein, 10 aa, Borrelia afzelii
QNRLESIKNS

SEQ ID NO: 214254 - protein, 10 aa, Borrelia afzelii
NRLESIKNST

SEQ ID NO: 214255 - protein, 10 aa, Borrelia afzelii
RLESIKNSTE

SEQ ID NO: 214256 - protein, 10 aa, Borrelia afzelii
LESIKNSTEY

SEQ ID NO: 214257 - protein, 10 aa, Borrelia afzelii
ESIKNSTEYA

SEQ ID NO: 214258 - protein, 10 aa, Borrelia afzelii
SIKNSTEYAI

SEQ ID NO: 214259 - protein, 10 aa, Borrelia afzelii
IKNSTEYAIE

SEQ ID NO: 214260 - protein, 10 aa, Borrelia afzelii
KNSTEYAIEN

SEQ ID NO: 214261 - protein, 10 aa, Borrelia afzelii
NSTEYAIENL

SEQ ID NO: 214262 - protein, 10 aa, Borrelia afzelii
STEYAIENLK

SEQ ID NO: 214263 - protein, 10 aa, Borrelia afzelii
TEYAIENLKA

SEQ ID NO: 214264 - protein, 10 aa, Borrelia afzelii
EYAIENLKAS

SEQ ID NO: 214265 - protein, 10 aa, Borrelia afzelii
YAIENLKASY

SEQ ID NO: 214266 - protein, 10 aa, Borrelia afzelii
AIENLKASYA

SEQ ID NO: 214267 - protein, 10 aa, Borrelia afzelii
IENLKASYAQ

SEQ ID NO: 214268 - protein, 10 aa, Borrelia afzelii
ENLKASYAQI

SEQ ID NO: 214269 - protein, 10 aa, Borrelia afzelii
NLKASYAQIK

SEQ ID NO: 214270 - protein, 10 aa, Borrelia afzelii
LKASYAQIKD

SEQ ID NO: 214271 - protein, 10 aa, Borrelia afzelii
KASYAQIKDA

SEQ ID NO: 214272 - protein, 10 aa, Borrelia afzelii
ASYAQIKDAT

SEQ ID NO: 214273 - protein, 10 aa, Borrelia afzelii
SYAQIKDATM

SEQ ID NO: 214274 - protein, 10 aa, Borrelia afzelii
YAQIKDATMT

SEQ ID NO: 214275 - protein, 10 aa, Borrelia afzelii
AQIKDATMTD

SEQ ID NO: 214276 - protein, 10 aa, Borrelia afzelii
QIKDATMTDE

SEQ ID NO: 214277 - protein, 10 aa, Borrelia afzelii
IKDATMTDEV

SEQ ID NO: 214278 - protein, 10 aa, Borrelia afzelii
KDATMTDEVV

SEQ ID NO: 214279 - protein, 10 aa, Borrelia afzelii
DATMTDEVVA

SEQ ID NO: 214280 - protein, 10 aa, Borrelia afzelii
ATMTDEVVAA

SEQ ID NO: 214281 - protein, 10 aa, Borrelia afzelii
TMTDEVVAAT

SEQ ID NO: 214282 - protein, 10 aa, Borrelia afzelii
MTDEVVAATT

SEQ ID NO: 214283 - protein, 10 aa, Borrelia afzelii
TDEVVAATTN

SEQ ID NO: 214284 - protein, 10 aa, Borrelia afzelii
DEVVAATTNS

SEQ ID NO: 214285 - protein, 10 aa, Borrelia afzelii
EVVAATTNSI

SEQ ID NO: 214286 - protein, 10 aa, Borrelia afzelii
VVAATTNSIL

SEQ ID NO: 214287 - protein, 10 aa, Borrelia afzelii
VAATTNSILT

SEQ ID NO: 214288 - protein, 10 aa, Borrelia afzelii
AATTNSILTQ

SEQ ID NO: 214289 - protein, 10 aa, Borrelia afzelii
ATTNSILTQS

SEQ ID NO: 214290 - protein, 10 aa, Borrelia afzelii
TTNSILTQSA

SEQ ID NO: 214291 - protein, 10 aa, Borrelia afzelii
TNSILTQSAM

SEQ ID NO: 214292 - protein, 10 aa, Borrelia afzelii
NSILTQSAMA

SEQ ID NO: 214293 - protein, 10 aa, Borrelia afzelii
SILTQSAMAM

SEQ ID NO: 214294 - protein, 10 aa, Borrelia afzelii
ILTQSAMAMI

SEQ ID NO: 214295 - protein, 10 aa, Borrelia afzelii
LTQSAMAMIA

SEQ ID NO: 214296 - protein, 10 aa, Borrelia afzelii
TQSAMAMIAQ

SEQ ID NO: 214297 - protein, 10 aa, Borrelia afzelii
QSAMAMIAQA

SEQ ID NO: 214298 - protein, 10 aa, Borrelia afzelii
SAMAMIAQAN

SEQ ID NO: 214299 - protein, 10 aa, Borrelia afzelii
AMAMIAQANQ

SEQ ID NO: 214300 - protein, 10 aa, Borrelia afzelii
MAMIAQANQV

SEQ ID NO: 214301 - protein, 10 aa, Borrelia afzelii
AMIAQANQVP

SEQ ID NO: 214302 - protein, 10 aa, Borrelia afzelii
MIAQANQVPQ

SEQ ID NO: 214303 - protein, 10 aa, Borrelia afzelii
IAQANQVPQY

SEQ ID NO: 214304 - protein, 10 aa, Borrelia afzelii
AQANQVPQYV

SEQ ID NO: 214305 - protein, 10 aa, Borrelia afzelii
QANQVPQYVL

SEQ ID NO: 214306 - protein, 10 aa, Borrelia afzelii
ANQVPQYVLS

SEQ ID NO: 214307 - protein, 10 aa, Borrelia afzelii
NQVPQYVLSL

SEQ ID NO: 214308 - protein, 10 aa, Borrelia afzelii
QVPQYVLSLL

SEQ ID NO: 214309 - protein, 10 aa, Borrelia afzelii
VPQYVLSLLR

SEQ ID NO: 214310 - protein, 11 aa, Borrelia afzelii
MIINHNTSAIN

SEQ ID NO: 214311 - protein, 11 aa, Borrelia afzelii
IINHNTSAINA

SEQ ID NO: 214312 - protein, 11 aa, Borrelia afzelii
INHNTSAINAS

SEQ ID NO: 214313 - protein, 11 aa, Borrelia afzelii
NHNTSAINASR

SEQ ID NO: 214314 - protein, 11 aa, Borrelia afzelii
HNTSAINASRN

SEQ ID NO: 214315 - protein, 11 aa, Borrelia afzelii
NTSAINASRNN

SEQ ID NO: 214316 - protein, 11 aa, Borrelia afzelii
TSAINASRNNA

SEQ ID NO: 214317 - protein, 11 aa, Borrelia afzelii
SAINASRNNAI

SEQ ID NO: 214318 - protein, 11 aa, Borrelia afzelii
AINASRNNAIN

SEQ ID NO: 214319 - protein, 11 aa, Borrelia afzelii
INASRNNAINA

SEQ ID NO: 214320 - protein, 11 aa, Borrelia afzelii
NASRNNAINAA

SEQ ID NO: 214321 - protein, 11 aa, Borrelia afzelii
ASRNNAINAAN

SEQ ID NO: 214322 - protein, 11 aa, Borrelia afzelii
SRNNAINAANL

SEQ ID NO: 214323 - protein, 11 aa, Borrelia afzelii
RNNAINAANLS

SEQ ID NO: 214324 - protein, 11 aa, Borrelia afzelii
NNAINAANLSK

SEQ ID NO: 214325 - protein, 11 aa, Borrelia afzelii
NAINAANLSKT

SEQ ID NO: 214326 - protein, 11 aa, Borrelia afzelii
AINAANLSKTQ

SEQ ID NO: 214327 - protein, 11 aa, Borrelia afzelii
INAANLSKTQE

SEQ ID NO: 214328 - protein, 11 aa, Borrelia afzelii
NAANLSKTQEK

SEQ ID NO: 214329 - protein, 11 aa, Borrelia afzelii
AANLSKTQEKL

SEQ ID NO: 214330 - protein, 11 aa, Borrelia afzelii
ANLSKTQEKLS

SEQ ID NO: 214331 - protein, 11 aa, Borrelia afzelii
NLSKTQEKLSS

SEQ ID NO: 214332 - protein, 11 aa, Borrelia afzelii
LSKTQEKLSSG

SEQ ID NO: 214333 - protein, 11 aa, Borrelia afzelii
SKTQEKLSSGY

SEQ ID NO: 214334 - protein, 11 aa, Borrelia afzelii
KTQEKLSSGYR

SEQ ID NO: 214335 - protein, 11 aa, Borrelia afzelii
TQEKLSSGYRI

SEQ ID NO: 214336 - protein, 11 aa, Borrelia afzelii
QEKLSSGYRIN

SEQ ID NO: 214337 - protein, 11 aa, Borrelia afzelii
EKLSSGYRINR

SEQ ID NO: 214338 - protein, 11 aa, Borrelia afzelii
KLSSGYRINRA

SEQ ID NO: 214339 - protein, 11 aa, Borrelia afzelii
LSSGYRINRAS

SEQ ID NO: 214340 - protein, 11 aa, Borrelia afzelii
SSGYRINRASD

SEQ ID NO: 214341 - protein, 11 aa, Borrelia afzelii
SGYRINRASDD

SEQ ID NO: 214342 - protein, 11 aa, Borrelia afzelii
GYRINRASDDA

SEQ ID NO: 214343 - protein, 11 aa, Borrelia afzelii
YRINRASDDAA

SEQ ID NO: 214344 - protein, 11 aa, Borrelia afzelii
RINRASDDAAG

SEQ ID NO: 214345 - protein, 11 aa, Borrelia afzelii
INRASDDAAGM

SEQ ID NO: 214346 - protein, 11 aa, Borrelia afzelii
NRASDDAAGMG

SEQ ID NO: 214347 - protein, 11 aa, Borrelia afzelii
RASDDAAGMGV

SEQ ID NO: 214348 - protein, 11 aa, Borrelia afzelii
ASDDAAGMGVS

SEQ ID NO: 214349 - protein, 11 aa, Borrelia afzelii
SDDAAGMGVSG

SEQ ID NO: 214350 - protein, 11 aa, Borrelia afzelii
DDAAGMGVSGK

SEQ ID NO: 214351 - protein, 11 aa, Borrelia afzelii
DAAGMGVSGKI

SEQ ID NO: 214352 - protein, 11 aa, Borrelia afzelii
AAGMGVSGKIN

SEQ ID NO: 214353 - protein, 11 aa, Borrelia afzelii
AGMGVSGKINA

SEQ ID NO: 214354 - protein, 11 aa, Borrelia afzelii
GMGVSGKINAQ

SEQ ID NO: 214355 - protein, 11 aa, Borrelia afzelii
MGVSGKINAQI

SEQ ID NO: 214356 - protein, 11 aa, Borrelia afzelii
GVSGKINAQIR

SEQ ID NO: 214357 - protein, 11 aa, Borrelia afzelii
VSGKINAQIRG

SEQ ID NO: 214358 - protein, 11 aa, Borrelia afzelii
SGKINAQIRGL

SEQ ID NO: 214359 - protein, 11 aa, Borrelia afzelii
GKINAQIRGLS

SEQ ID NO: 214360 - protein, 11 aa, Borrelia afzelii
KINAQIRGLSQ

SEQ ID NO: 214361 - protein, 11 aa, Borrelia afzelii
INAQIRGLSQA

SEQ ID NO: 214362 - protein, 11 aa, Borrelia afzelii
NAQIRGLSQAS

SEQ ID NO: 214363 - protein, 11 aa, Borrelia afzelii
AQIRGLSQASR

SEQ ID NO: 214364 - protein, 11 aa, Borrelia afzelii
QIRGLSQASRN

SEQ ID NO: 214365 - protein, 11 aa, Borrelia afzelii
IRGLSQASRNT

SEQ ID NO: 214366 - protein, 11 aa, Borrelia afzelii
RGLSQASRNTS

SEQ ID NO: 214367 - protein, 11 aa, Borrelia afzelii
GLSQASRNTSK

SEQ ID NO: 214368 - protein, 11 aa, Borrelia afzelii
LSQASRNTSKA

SEQ ID NO: 214369 - protein, 11 aa, Borrelia afzelii
SQASRNTSKAI

SEQ ID NO: 214370 - protein, 11 aa, Borrelia afzelii
QASRNTSKAIN

SEQ ID NO: 214371 - protein, 11 aa, Borrelia afzelii
ASRNTSKAINF

SEQ ID NO: 214372 - protein, 11 aa, Borrelia afzelii
SRNTSKAINFI

SEQ ID NO: 214373 - protein, 11 aa, Borrelia afzelii
RNTSKAINFIQ

SEQ ID NO: 214374 - protein, 11 aa, Borrelia afzelii
NTSKAINFIQT

SEQ ID NO: 214375 - protein, 11 aa, Borrelia afzelii
TSKAINFIQTT

SEQ ID NO: 214376 - protein, 11 aa, Borrelia afzelii
SKAINFIQTTE

SEQ ID NO: 214377 - protein, 11 aa, Borrelia afzelii
KAINFIQTTEG

SEQ ID NO: 214378 - protein, 11 aa, Borrelia afzelii
AINFIQTTEGN

SEQ ID NO: 214379 - protein, 11 aa, Borrelia afzelii
INFIQTTEGNL

SEQ ID NO: 214380 - protein, 11 aa, Borrelia afzelii
NFIQTTEGNLN

SEQ ID NO: 214381 - protein, 11 aa, Borrelia afzelii
FIQTTEGNLNE

SEQ ID NO: 214382 - protein, 11 aa, Borrelia afzelii
IQTTEGNLNEV

SEQ ID NO: 214383 - protein, 11 aa, Borrelia afzelii
QTTEGNLNEVE

SEQ ID NO: 214384 - protein, 11 aa, Borrelia afzelii
TTEGNLNEVEK

SEQ ID NO: 214385 - protein, 11 aa, Borrelia afzelii
TEGNLNEVEKV

SEQ ID NO: 214386 - protein, 11 aa, Borrelia afzelii
EGNLNEVEKVL

SEQ ID NO: 214387 - protein, 11 aa, Borrelia afzelii
GNLNEVEKVLV

SEQ ID NO: 214388 - protein, 11 aa, Borrelia afzelii
NLNEVEKVLVR

SEQ ID NO: 214389 - protein, 11 aa, Borrelia afzelii
LNEVEKVLVRM

SEQ ID NO: 214390 - protein, 11 aa, Borrelia afzelii
NEVEKVLVRMK

SEQ ID NO: 214391 - protein, 11 aa, Borrelia afzelii
EVEKVLVRMKE

SEQ ID NO: 214392 - protein, 11 aa, Borrelia afzelii
VEKVLVRMKEL

SEQ ID NO: 214393 - protein, 11 aa, Borrelia afzelii
EKVLVRMKELA

SEQ ID NO: 214394 - protein, 11 aa, Borrelia afzelii
KVLVRMKELAV

SEQ ID NO: 214395 - protein, 11 aa, Borrelia afzelii
VLVRMKELAVQ

SEQ ID NO: 214396 - protein, 11 aa, Borrelia afzelii
LVRMKELAVQS

SEQ ID NO: 214397 - protein, 11 aa, Borrelia afzelii
VRMKELAVQSG

SEQ ID NO: 214398 - protein, 11 aa, Borrelia afzelii
RMKELAVQSGN

SEQ ID NO: 214399 - protein, 11 aa, Borrelia afzelii
MKELAVQSGNG

SEQ ID NO: 214400 - protein, 11 aa, Borrelia afzelii
KELAVQSGNGT

SEQ ID NO: 214401 - protein, 11 aa, Borrelia afzelii
ELAVQSGNGTY

SEQ ID NO: 214402 - protein, 11 aa, Borrelia afzelii
LAVQSGNGTYS

SEQ ID NO: 214403 - protein, 11 aa, Borrelia afzelii
AVQSGNGTYSD

SEQ ID NO: 214404 - protein, 11 aa, Borrelia afzelii
VQSGNGTYSDS

SEQ ID NO: 214405 - protein, 11 aa, Borrelia afzelii
QSGNGTYSDSD

SEQ ID NO: 214406 - protein, 11 aa, Borrelia afzelii
SGNGTYSDSDR

SEQ ID NO: 214407 - protein, 11 aa, Borrelia afzelii
GNGTYSDSDRG

SEQ ID NO: 214408 - protein, 11 aa, Borrelia afzelii
NGTYSDSDRGS

SEQ ID NO: 214409 - protein, 11 aa, Borrelia afzelii
GTYSDSDRGSI

SEQ ID NO: 214410 - protein, 11 aa, Borrelia afzelii
TYSDSDRGSIQ

SEQ ID NO: 214411 - protein, 11 aa, Borrelia afzelii
YSDSDRGSIQI

SEQ ID NO: 214412 - protein, 11 aa, Borrelia afzelii
SDSDRGSIQIE

SEQ ID NO: 214413 - protein, 11 aa, Borrelia afzelii
DSDRGSIQIEI

SEQ ID NO: 214414 - protein, 11 aa, Borrelia afzelii
SDRGSIQIEIE

SEQ ID NO: 214415 - protein, 11 aa, Borrelia afzelii
DRGSIQIEIEQ

SEQ ID NO: 214416 - protein, 11 aa, Borrelia afzelii
RGSIQIEIEQL

SEQ ID NO: 214417 - protein, 11 aa, Borrelia afzelii
GSIQIEIEQLT

SEQ ID NO: 214418 - protein, 11 aa, Borrelia afzelii
SIQIEIEQLTD

SEQ ID NO: 214419 - protein, 11 aa, Borrelia afzelii
IQIEIEQLTDE

SEQ ID NO: 214420 - protein, 11 aa, Borrelia afzelii
QIEIEQLTDEI

SEQ ID NO: 214421 - protein, 11 aa, Borrelia afzelii
IEIEQLTDEIN

SEQ ID NO: 214422 - protein, 11 aa, Borrelia afzelii
EIEQLTDEINR

SEQ ID NO: 214423 - protein, 11 aa, Borrelia afzelii
IEQLTDEINRI

SEQ ID NO: 214424 - protein, 11 aa, Borrelia afzelii
EQLTDEINRIA

SEQ ID NO: 214425 - protein, 11 aa, Borrelia afzelii
QLTDEINRIAD

SEQ ID NO: 214426 - protein, 11 aa, Borrelia afzelii
LTDEINRIADQ

SEQ ID NO: 214427 - protein, 11 aa, Borrelia afzelii
TDEINRIADQA

SEQ ID NO: 214428 - protein, 11 aa, Borrelia afzelii
DEINRIADQAQ

SEQ ID NO: 214429 - protein, 11 aa, Borrelia afzelii
EINRIADQAQY

SEQ ID NO: 214430 - protein, 11 aa, Borrelia afzelii
INRIADQAQYN

SEQ ID NO: 214431 - protein, 11 aa, Borrelia afzelii
NRIADQAQYNQ

SEQ ID NO: 214432 - protein, 11 aa, Borrelia afzelii
RIADQAQYNQM

SEQ ID NO: 214433 - protein, 11 aa, Borrelia afzelii
IADQAQYNQMH

SEQ ID NO: 214434 - protein, 11 aa, Borrelia afzelii
ADQAQYNQMHM

SEQ ID NO: 214435 - protein, 11 aa, Borrelia afzelii
DQAQYNQMHML

SEQ ID NO: 214436 - protein, 11 aa, Borrelia afzelii
QAQYNQMHMLS

SEQ ID NO: 214437 - protein, 11 aa, Borrelia afzelii
AQYNQMHMLSN

SEQ ID NO: 214438 - protein, 11 aa, Borrelia afzelii
QYNQMHMLSNK

SEQ ID NO: 214439 - protein, 11 aa, Borrelia afzelii
YNQMHMLSNKS

SEQ ID NO: 214440 - protein, 11 aa, Borrelia afzelii
NQMHMLSNKSA

SEQ ID NO: 214441 - protein, 11 aa, Borrelia afzelii
QMHMLSNKSAS

SEQ ID NO: 214442 - protein, 11 aa, Borrelia afzelii
MHMLSNKSASQ

SEQ ID NO: 214443 - protein, 11 aa, Borrelia afzelii
HMLSNKSASQN

SEQ ID NO: 214444 - protein, 11 aa, Borrelia afzelii
MLSNKSASQNV

SEQ ID NO: 214445 - protein, 11 aa, Borrelia afzelii
LSNKSASQNVK

SEQ ID NO: 214446 - protein, 11 aa, Borrelia afzelii
SNKSASQNVKT

SEQ ID NO: 214447 - protein, 11 aa, Borrelia afzelii
NKSASQNVKTA

SEQ ID NO: 214448 - protein, 11 aa, Borrelia afzelii
KSASQNVKTAE

SEQ ID NO: 214449 - protein, 11 aa, Borrelia afzelii
SASQNVKTAEE

SEQ ID NO: 214450 - protein, 11 aa, Borrelia afzelii
ASQNVKTAEEL

SEQ ID NO: 214451 - protein, 11 aa, Borrelia afzelii
SQNVKTAEELG

SEQ ID NO: 214452 - protein, 11 aa, Borrelia afzelii
QNVKTAEELGM

SEQ ID NO: 214453 - protein, 11 aa, Borrelia afzelii
NVKTAEELGMQ

SEQ ID NO: 214454 - protein, 11 aa, Borrelia afzelii
VKTAEELGMQP

SEQ ID NO: 214455 - protein, 11 aa, Borrelia afzelii
KTAEELGMQPA

SEQ ID NO: 214456 - protein, 11 aa, Borrelia afzelii
TAEELGMQPAK

SEQ ID NO: 214457 - protein, 11 aa, Borrelia afzelii
AEELGMQPAKI

SEQ ID NO: 214458 - protein, 11 aa, Borrelia afzelii
EELGMQPAKIN

SEQ ID NO: 214459 - protein, 11 aa, Borrelia afzelii
ELGMQPAKINT

SEQ ID NO: 214460 - protein, 11 aa, Borrelia afzelii
LGMQPAKINTP

SEQ ID NO: 214461 - protein, 11 aa, Borrelia afzelii
GMQPAKINTPA

SEQ ID NO: 214462 - protein, 11 aa, Borrelia afzelii
MQPAKINTPAS

SEQ ID NO: 214463 - protein, 11 aa, Borrelia afzelii
QPAKINTPASL

SEQ ID NO: 214464 - protein, 11 aa, Borrelia afzelii
PAKINTPASLS

SEQ ID NO: 214465 - protein, 11 aa, Borrelia afzelii
AKINTPASLSG

SEQ ID NO: 214466 - protein, 11 aa, Borrelia afzelii
KINTPASLSGS

SEQ ID NO: 214467 - protein, 11 aa, Borrelia afzelii
INTPASLSGSQ

SEQ ID NO: 214468 - protein, 11 aa, Borrelia afzelii
NTPASLSGSQA

SEQ ID NO: 214469 - protein, 11 aa, Borrelia afzelii
TPASLSGSQAS

SEQ ID NO: 214470 - protein, 11 aa, Borrelia afzelii
PASLSGSQASW

SEQ ID NO: 214471 - protein, 11 aa, Borrelia afzelii
ASLSGSQASWT

SEQ ID NO: 214472 - protein, 11 aa, Borrelia afzelii
SLSGSQASWTL

SEQ ID NO: 214473 - protein, 11 aa, Borrelia afzelii
LSGSQASWTLR

SEQ ID NO: 214474 - protein, 11 aa, Borrelia afzelii
SGSQASWTLRV

SEQ ID NO: 214475 - protein, 11 aa, Borrelia afzelii
GSQASWTLRVH

SEQ ID NO: 214476 - protein, 11 aa, Borrelia afzelii
SQASWTLRVHV

SEQ ID NO: 214477 - protein, 11 aa, Borrelia afzelii
QASWTLRVHVG

SEQ ID NO: 214478 - protein, 11 aa, Borrelia afzelii
ASWTLRVHVGA

SEQ ID NO: 214479 - protein, 11 aa, Borrelia afzelii
SWTLRVHVGAN

SEQ ID NO: 214480 - protein, 11 aa, Borrelia afzelii
WTLRVHVGANQ

SEQ ID NO: 214481 - protein, 11 aa, Borrelia afzelii
TLRVHVGANQD

SEQ ID NO: 214482 - protein, 11 aa, Borrelia afzelii
LRVHVGANQDE

SEQ ID NO: 214483 - protein, 11 aa, Borrelia afzelii
RVHVGANQDEA

SEQ ID NO: 214484 - protein, 11 aa, Borrelia afzelii
VHVGANQDEAI

SEQ ID NO: 214485 - protein, 11 aa, Borrelia afzelii
HVGANQDEAIA

SEQ ID NO: 214486 - protein, 11 aa, Borrelia afzelii
VGANQDEAIAV

SEQ ID NO: 214487 - protein, 11 aa, Borrelia afzelii
GANQDEAIAVN

SEQ ID NO: 214488 - protein, 11 aa, Borrelia afzelii
ANQDEAIAVNI

SEQ ID NO: 214489 - protein, 11 aa, Borrelia afzelii
NQDEAIAVNIY

SEQ ID NO: 214490 - protein, 11 aa, Borrelia afzelii
QDEAIAVNIYS

SEQ ID NO: 214491 - protein, 11 aa, Borrelia afzelii
DEAIAVNIYSA

SEQ ID NO: 214492 - protein, 11 aa, Borrelia afzelii
EAIAVNIYSAN

SEQ ID NO: 214493 - protein, 11 aa, Borrelia afzelii
AIAVNIYSANV

SEQ ID NO: 214494 - protein, 11 aa, Borrelia afzelii
IAVNIYSANVA

SEQ ID NO: 214495 - protein, 11 aa, Borrelia afzelii
AVNIYSANVAN

SEQ ID NO: 214496 - protein, 11 aa, Borrelia afzelii
VNIYSANVANL

SEQ ID NO: 214497 - protein, 11 aa, Borrelia afzelii
NIYSANVANLF

SEQ ID NO: 214498 - protein, 11 aa, Borrelia afzelii
IYSANVANLFA

SEQ ID NO: 214499 - protein, 11 aa, Borrelia afzelii
YSANVANLFAG

SEQ ID NO: 214500 - protein, 11 aa, Borrelia afzelii
SANVANLFAGE

SEQ ID NO: 214501 - protein, 11 aa, Borrelia afzelii
ANVANLFAGEG

SEQ ID NO: 214502 - protein, 11 aa, Borrelia afzelii
NVANLFAGEGA

SEQ ID NO: 214503 - protein, 11 aa, Borrelia afzelii
VANLFAGEGAQ

SEQ ID NO: 214504 - protein, 11 aa, Borrelia afzelii
ANLFAGEGAQA

SEQ ID NO: 214505 - protein, 11 aa, Borrelia afzelii
NLFAGEGAQAA

SEQ ID NO: 214506 - protein, 11 aa, Borrelia afzelii
LFAGEGAQAAQ

SEQ ID NO: 214507 - protein, 11 aa, Borrelia afzelii
FAGEGAQAAQA

SEQ ID NO: 214508 - protein, 11 aa, Borrelia afzelii
AGEGAQAAQAA

SEQ ID NO: 214509 - protein, 11 aa, Borrelia afzelii
GEGAQAAQAAP

SEQ ID NO: 214510 - protein, 11 aa, Borrelia afzelii
EGAQAAQAAPV

SEQ ID NO: 214511 - protein, 11 aa, Borrelia afzelii
GAQAAQAAPVQ

SEQ ID NO: 214512 - protein, 11 aa, Borrelia afzelii
AQAAQAAPVQE

SEQ ID NO: 214513 - protein, 11 aa, Borrelia afzelii
QAAQAAPVQEG

SEQ ID NO: 214514 - protein, 11 aa, Borrelia afzelii
AAQAAPVQEGA

SEQ ID NO: 214515 - protein, 11 aa, Borrelia afzelii
AQAAPVQEGAQ

SEQ ID NO: 214516 - protein, 11 aa, Borrelia afzelii
QAAPVQEGAQE

SEQ ID NO: 214517 - protein, 11 aa, Borrelia afzelii
AAPVQEGAQEE

SEQ ID NO: 214518 - protein, 11 aa, Borrelia afzelii
APVQEGAQEEG

SEQ ID NO: 214519 - protein, 11 aa, Borrelia afzelii
PVQEGAQEEGA

SEQ ID NO: 214520 - protein, 11 aa, Borrelia afzelii
VQEGAQEEGAQ

SEQ ID NO: 214521 - protein, 11 aa, Borrelia afzelii
QEGAQEEGAQQ

SEQ ID NO: 214522 - protein, 11 aa, Borrelia afzelii
EGAQEEGAQQP

SEQ ID NO: 214523 - protein, 11 aa, Borrelia afzelii
GAQEEGAQQPT

SEQ ID NO: 214524 - protein, 11 aa, Borrelia afzelii
AQEEGAQQPTP

SEQ ID NO: 214525 - protein, 11 aa, Borrelia afzelii
QEEGAQQPTPA

SEQ ID NO: 214526 - protein, 11 aa, Borrelia afzelii
EEGAQQPTPAT

SEQ ID NO: 214527 - protein, 11 aa, Borrelia afzelii
EGAQQPTPATA

SEQ ID NO: 214528 - protein, 11 aa, Borrelia afzelii
GAQQPTPATAP

SEQ ID NO: 214529 - protein, 11 aa, Borrelia afzelii
AQQPTPATAPT

SEQ ID NO: 214530 - protein, 11 aa, Borrelia afzelii
QQPTPATAPTQ

SEQ ID NO: 214531 - protein, 11 aa, Borrelia afzelii
QPTPATAPTQG

SEQ ID NO: 214532 - protein, 11 aa, Borrelia afzelii
PTPATAPTQGG

SEQ ID NO: 214533 - protein, 11 aa, Borrelia afzelii
TPATAPTQGGV

SEQ ID NO: 214534 - protein, 11 aa, Borrelia afzelii
PATAPTQGGVN

SEQ ID NO: 214535 - protein, 11 aa, Borrelia afzelii
ATAPTQGGVNS

SEQ ID NO: 214536 - protein, 11 aa, Borrelia afzelii
TAPTQGGVNSP

SEQ ID NO: 214537 - protein, 11 aa, Borrelia afzelii
APTQGGVNSPV

SEQ ID NO: 214538 - protein, 11 aa, Borrelia afzelii
PTQGGVNSPVN

SEQ ID NO: 214539 - protein, 11 aa, Borrelia afzelii
TQGGVNSPVNV

SEQ ID NO: 214540 - protein, 11 aa, Borrelia afzelii
QGGVNSPVNVT

SEQ ID NO: 214541 - protein, 11 aa, Borrelia afzelii
GGVNSPVNVTT

SEQ ID NO: 214542 - protein, 11 aa, Borrelia afzelii
GVNSPVNVTTT

SEQ ID NO: 214543 - protein, 11 aa, Borrelia afzelii
VNSPVNVTTTV

SEQ ID NO: 214544 - protein, 11 aa, Borrelia afzelii
NSPVNVTTTVD

SEQ ID NO: 214545 - protein, 11 aa, Borrelia afzelii
SPVNVTTTVDA

SEQ ID NO: 214546 - protein, 11 aa, Borrelia afzelii
PVNVTTTVDAN

SEQ ID NO: 214547 - protein, 11 aa, Borrelia afzelii
VNVTTTVDANT

SEQ ID NO: 214548 - protein, 11 aa, Borrelia afzelii
NVTTTVDANTS

SEQ ID NO: 214549 - protein, 11 aa, Borrelia afzelii
VTTTVDANTSL

SEQ ID NO: 214550 - protein, 11 aa, Borrelia afzelii
TTTVDANTSLA

SEQ ID NO: 214551 - protein, 11 aa, Borrelia afzelii
TTVDANTSLAK

SEQ ID NO: 214552 - protein, 11 aa, Borrelia afzelii
TVDANTSLAKI

SEQ ID NO: 214553 - protein, 11 aa, Borrelia afzelii
VDANTSLAKIE

SEQ ID NO: 214554 - protein, 11 aa, Borrelia afzelii
DANTSLAKIEN

SEQ ID NO: 214555 - protein, 11 aa, Borrelia afzelii
ANTSLAKIENA

SEQ ID NO: 214556 - protein, 11 aa, Borrelia afzelii
NTSLAKIENAI

SEQ ID NO: 214557 - protein, 11 aa, Borrelia afzelii
TSLAKIENAIR

SEQ ID NO: 214558 - protein, 11 aa, Borrelia afzelii
SLAKIENAIRM

SEQ ID NO: 214559 - protein, 11 aa, Borrelia afzelii
LAKIENAIRMI

SEQ ID NO: 214560 - protein, 11 aa, Borrelia afzelii
AKIENAIRMIS

SEQ ID NO: 214561 - protein, 11 aa, Borrelia afzelii
KIENAIRMISD

SEQ ID NO: 214562 - protein, 11 aa, Borrelia afzelii
IENAIRMISDQ

SEQ ID NO: 214563 - protein, 11 aa, Borrelia afzelii
ENAIRMISDQR

SEQ ID NO: 214564 - protein, 11 aa, Borrelia afzelii
NAIRMISDQRA

SEQ ID NO: 214565 - protein, 11 aa, Borrelia afzelii
AIRMISDQRAN

SEQ ID NO: 214566 - protein, 11 aa, Borrelia afzelii
IRMISDQRANL

SEQ ID NO: 214567 - protein, 11 aa, Borrelia afzelii
RMISDQRANLG

SEQ ID NO: 214568 - protein, 11 aa, Borrelia afzelii
MISDQRANLGA

SEQ ID NO: 214569 - protein, 11 aa, Borrelia afzelii
ISDQRANLGAF

SEQ ID NO: 214570 - protein, 11 aa, Borrelia afzelii
SDQRANLGAFQ

SEQ ID NO: 214571 - protein, 11 aa, Borrelia afzelii
DQRANLGAFQN

SEQ ID NO: 214572 - protein, 11 aa, Borrelia afzelii
QRANLGAFQNR

SEQ ID NO: 214573 - protein, 11 aa, Borrelia afzelii
RANLGAFQNRL

SEQ ID NO: 214574 - protein, 11 aa, Borrelia afzelii
ANLGAFQNRLE

SEQ ID NO: 214575 - protein, 11 aa, Borrelia afzelii
NLGAFQNRLES

SEQ ID NO: 214576 - protein, 11 aa, Borrelia afzelii
LGAFQNRLESI

SEQ ID NO: 214577 - protein, 11 aa, Borrelia afzelii
GAFQNRLESIK

SEQ ID NO: 214578 - protein, 11 aa, Borrelia afzelii
AFQNRLESIKN

SEQ ID NO: 214579 - protein, 11 aa, Borrelia afzelii
FQNRLESIKNS

SEQ ID NO: 214580 - protein, 11 aa, Borrelia afzelii
QNRLESIKNST

SEQ ID NO: 214581 - protein, 11 aa, Borrelia afzelii
NRLESIKNSTE

SEQ ID NO: 214582 - protein, 11 aa, Borrelia afzelii
RLESIKNSTEY

SEQ ID NO: 214583 - protein, 11 aa, Borrelia afzelii
LESIKNSTEYA

SEQ ID NO: 214584 - protein, 11 aa, Borrelia afzelii
ESIKNSTEYAI

SEQ ID NO: 214585 - protein, 11 aa, Borrelia afzelii
SIKNSTEYAIE

SEQ ID NO: 214586 - protein, 11 aa, Borrelia afzelii
IKNSTEYAIEN

SEQ ID NO: 214587 - protein, 11 aa, Borrelia afzelii
KNSTEYAIENL

SEQ ID NO: 214588 - protein, 11 aa, Borrelia afzelii
NSTEYAIENLK

SEQ ID NO: 214589 - protein, 11 aa, Borrelia afzelii
STEYAIENLKA

SEQ ID NO: 214590 - protein, 11 aa, Borrelia afzelii
TEYAIENLKAS

SEQ ID NO: 214591 - protein, 11 aa, Borrelia afzelii
EYAIENLKASY

SEQ ID NO: 214592 - protein, 11 aa, Borrelia afzelii
YAIENLKASYA

SEQ ID NO: 214593 - protein, 11 aa, Borrelia afzelii
AIENLKASYAQ

SEQ ID NO: 214594 - protein, 11 aa, Borrelia afzelii
IENLKASYAQI

SEQ ID NO: 214595 - protein, 11 aa, Borrelia afzelii
ENLKASYAQIK

SEQ ID NO: 214596 - protein, 11 aa, Borrelia afzelii
NLKASYAQIKD

SEQ ID NO: 214597 - protein, 11 aa, Borrelia afzelii
LKASYAQIKDA

SEQ ID NO: 214598 - protein, 11 aa, Borrelia afzelii
KASYAQIKDAT

SEQ ID NO: 214599 - protein, 11 aa, Borrelia afzelii
ASYAQIKDATM

SEQ ID NO: 214600 - protein, 11 aa, Borrelia afzelii
SYAQIKDATMT

SEQ ID NO: 214601 - protein, 11 aa, Borrelia afzelii
YAQIKDATMTD

SEQ ID NO: 214602 - protein, 11 aa, Borrelia afzelii
AQIKDATMTDE

SEQ ID NO: 214603 - protein, 11 aa, Borrelia afzelii
QIKDATMTDEV

SEQ ID NO: 214604 - protein, 11 aa, Borrelia afzelii
IKDATMTDEVV

SEQ ID NO: 214605 - protein, 11 aa, Borrelia afzelii
KDATMTDEVVA

SEQ ID NO: 214606 - protein, 11 aa, Borrelia afzelii
DATMTDEVVAA

SEQ ID NO: 214607 - protein, 11 aa, Borrelia afzelii
ATMTDEVVAAT

SEQ ID NO: 214608 - protein, 11 aa, Borrelia afzelii
TMTDEVVAATT

SEQ ID NO: 214609 - protein, 11 aa, Borrelia afzelii
MTDEVVAATTN

SEQ ID NO: 214610 - protein, 11 aa, Borrelia afzelii
TDEVVAATTNS

SEQ ID NO: 214611 - protein, 11 aa, Borrelia afzelii
DEVVAATTNSI

SEQ ID NO: 214612 - protein, 11 aa, Borrelia afzelii
EVVAATTNSIL

SEQ ID NO: 214613 - protein, 11 aa, Borrelia afzelii
VVAATTNSILT

SEQ ID NO: 214614 - protein, 11 aa, Borrelia afzelii
VAATTNSILTQ

SEQ ID NO: 214615 - protein, 11 aa, Borrelia afzelii
AATTNSILTQS

SEQ ID NO: 214616 - protein, 11 aa, Borrelia afzelii
ATTNSILTQSA

SEQ ID NO: 214617 - protein, 11 aa, Borrelia afzelii
TTNSILTQSAM

SEQ ID NO: 214618 - protein, 11 aa, Borrelia afzelii
TNSILTQSAMA

SEQ ID NO: 214619 - protein, 11 aa, Borrelia afzelii
NSILTQSAMAM

SEQ ID NO: 214620 - protein, 11 aa, Borrelia afzelii
SILTQSAMAMI

SEQ ID NO: 214621 - protein, 11 aa, Borrelia afzelii
ILTQSAMAMIA

SEQ ID NO: 214622 - protein, 11 aa, Borrelia afzelii
LTQSAMAMIAQ

SEQ ID NO: 214623 - protein, 11 aa, Borrelia afzelii
TQSAMAMIAQA

SEQ ID NO: 214624 - protein, 11 aa, Borrelia afzelii
QSAMAMIAQAN

SEQ ID NO: 214625 - protein, 11 aa, Borrelia afzelii
SAMAMIAQANQ

SEQ ID NO: 214626 - protein, 11 aa, Borrelia afzelii
AMAMIAQANQV

SEQ ID NO: 214627 - protein, 11 aa, Borrelia afzelii
MAMIAQANQVP

SEQ ID NO: 214628 - protein, 11 aa, Borrelia afzelii
AMIAQANQVPQ

SEQ ID NO: 214629 - protein, 11 aa, Borrelia afzelii
MIAQANQVPQY

SEQ ID NO: 214630 - protein, 11 aa, Borrelia afzelii
IAQANQVPQYV

SEQ ID NO: 214631 - protein, 11 aa, Borrelia afzelii
AQANQVPQYVL

SEQ ID NO: 214632 - protein, 11 aa, Borrelia afzelii
QANQVPQYVLS

SEQ ID NO: 214633 - protein, 11 aa, Borrelia afzelii
ANQVPQYVLSL

SEQ ID NO: 214634 - protein, 11 aa, Borrelia afzelii
NQVPQYVLSLL

SEQ ID NO: 214635 - protein, 11 aa, Borrelia afzelii
QVPQYVLSLLR

SEQ ID NO: 214636 - protein, 13 aa, Borrelia afzelii
MIINHNTSAINAS

SEQ ID NO: 214637 - protein, 13 aa, Borrelia afzelii
IINHNTSAINASR

SEQ ID NO: 214638 - protein, 13 aa, Borrelia afzelii
INHNTSAINASRN

SEQ ID NO: 214639 - protein, 13 aa, Borrelia afzelii
NHNTSAINASRNN

SEQ ID NO: 214640 - protein, 13 aa, Borrelia afzelii
HNTSAINASRNNA

SEQ ID NO: 214641 - protein, 13 aa, Borrelia afzelii
NTSAINASRNNAI

SEQ ID NO: 214642 - protein, 13 aa, Borrelia afzelii
TSAINASRNNAIN

SEQ ID NO: 214643 - protein, 13 aa, Borrelia afzelii
SAINASRNNAINA

SEQ ID NO: 214644 - protein, 13 aa, Borrelia afzelii
AINASRNNAINAA

SEQ ID NO: 214645 - protein, 13 aa, Borrelia afzelii
INASRNNAINAAN

SEQ ID NO: 214646 - protein, 13 aa, Borrelia afzelii
NASRNNAINAANL

SEQ ID NO: 214647 - protein, 13 aa, Borrelia afzelii
ASRNNAINAANLS

SEQ ID NO: 214648 - protein, 13 aa, Borrelia afzelii
SRNNAINAANLSK

SEQ ID NO: 214649 - protein, 13 aa, Borrelia afzelii
RNNAINAANLSKT

SEQ ID NO: 214650 - protein, 13 aa, Borrelia afzelii
NNAINAANLSKTQ

SEQ ID NO: 214651 - protein, 13 aa, Borrelia afzelii
NAINAANLSKTQE

SEQ ID NO: 214652 - protein, 13 aa, Borrelia afzelii
AINAANLSKTQEK

SEQ ID NO: 214653 - protein, 13 aa, Borrelia afzelii
INAANLSKTQEKL

SEQ ID NO: 214654 - protein, 13 aa, Borrelia afzelii
NAANLSKTQEKLS

SEQ ID NO: 214655 - protein, 13 aa, Borrelia afzelii
AANLSKTQEKLSS

SEQ ID NO: 214656 - protein, 13 aa, Borrelia afzelii
ANLSKTQEKLSSG

SEQ ID NO: 214657 - protein, 13 aa, Borrelia afzelii
NLSKTQEKLSSGY

SEQ ID NO: 214658 - protein, 13 aa, Borrelia afzelii
LSKTQEKLSSGYR

SEQ ID NO: 214659 - protein, 13 aa, Borrelia afzelii
SKTQEKLSSGYRI

SEQ ID NO: 214660 - protein, 13 aa, Borrelia afzelii
KTQEKLSSGYRIN

SEQ ID NO: 214661 - protein, 13 aa, Borrelia afzelii
TQEKLSSGYRINR

SEQ ID NO: 214662 - protein, 13 aa, Borrelia afzelii
QEKLSSGYRINRA

SEQ ID NO: 214663 - protein, 13 aa, Borrelia afzelii
EKLSSGYRINRAS

SEQ ID NO: 214664 - protein, 13 aa, Borrelia afzelii
KLSSGYRINRASD

SEQ ID NO: 214665 - protein, 13 aa, Borrelia afzelii
LSSGYRINRASDD

SEQ ID NO: 214666 - protein, 13 aa, Borrelia afzelii
SSGYRINRASDDA

SEQ ID NO: 214667 - protein, 13 aa, Borrelia afzelii
SGYRINRASDDAA

SEQ ID NO: 214668 - protein, 13 aa, Borrelia afzelii
GYRINRASDDAAG

SEQ ID NO: 214669 - protein, 13 aa, Borrelia afzelii
YRINRASDDAAGM

SEQ ID NO: 214670 - protein, 13 aa, Borrelia afzelii
RINRASDDAAGMG

SEQ ID NO: 214671 - protein, 13 aa, Borrelia afzelii
INRASDDAAGMGV

SEQ ID NO: 214672 - protein, 13 aa, Borrelia afzelii
NRASDDAAGMGVS

SEQ ID NO: 214673 - protein, 13 aa, Borrelia afzelii
RASDDAAGMGVSG

SEQ ID NO: 214674 - protein, 13 aa, Borrelia afzelii
ASDDAAGMGVSGK

SEQ ID NO: 214675 - protein, 13 aa, Borrelia afzelii
SDDAAGMGVSGKI

SEQ ID NO: 214676 - protein, 13 aa, Borrelia afzelii
DDAAGMGVSGKIN

SEQ ID NO: 214677 - protein, 13 aa, Borrelia afzelii
DAAGMGVSGKINA

SEQ ID NO: 214678 - protein, 13 aa, Borrelia afzelii
AAGMGVSGKINAQ

SEQ ID NO: 214679 - protein, 13 aa, Borrelia afzelii
AGMGVSGKINAQI

SEQ ID NO: 214680 - protein, 13 aa, Borrelia afzelii
GMGVSGKINAQIR

SEQ ID NO: 214681 - protein, 13 aa, Borrelia afzelii
MGVSGKINAQIRG

SEQ ID NO: 214682 - protein, 13 aa, Borrelia afzelii
GVSGKINAQIRGL

SEQ ID NO: 214683 - protein, 13 aa, Borrelia afzelii
VSGKINAQIRGLS

SEQ ID NO: 214684 - protein, 13 aa, Borrelia afzelii
SGKINAQIRGLSQ

SEQ ID NO: 214685 - protein, 13 aa, Borrelia afzelii
GKINAQIRGLSQA

SEQ ID NO: 214686 - protein, 13 aa, Borrelia afzelii
KINAQIRGLSQAS

SEQ ID NO: 214687 - protein, 13 aa, Borrelia afzelii
INAQIRGLSQASR

SEQ ID NO: 214688 - protein, 13 aa, Borrelia afzelii
NAQIRGLSQASRN

SEQ ID NO: 214689 - protein, 13 aa, Borrelia afzelii
AQIRGLSQASRNT

SEQ ID NO: 214690 - protein, 13 aa, Borrelia afzelii
QIRGLSQASRNTS

SEQ ID NO: 214691 - protein, 13 aa, Borrelia afzelii
IRGLSQASRNTSK

SEQ ID NO: 214692 - protein, 13 aa, Borrelia afzelii
RGLSQASRNTSKA

SEQ ID NO: 214693 - protein, 13 aa, Borrelia afzelii
GLSQASRNTSKAI

SEQ ID NO: 214694 - protein, 13 aa, Borrelia afzelii
LSQASRNTSKAIN

SEQ ID NO: 214695 - protein, 13 aa, Borrelia afzelii
SQASRNTSKAINF

SEQ ID NO: 214696 - protein, 13 aa, Borrelia afzelii
QASRNTSKAINFI

SEQ ID NO: 214697 - protein, 13 aa, Borrelia afzelii
ASRNTSKAINFIQ

SEQ ID NO: 214698 - protein, 13 aa, Borrelia afzelii
SRNTSKAINFIQT

SEQ ID NO: 214699 - protein, 13 aa, Borrelia afzelii
RNTSKAINFIQTT

SEQ ID NO: 214700 - protein, 13 aa, Borrelia afzelii
NTSKAINFIQTTE

SEQ ID NO: 214701 - protein, 13 aa, Borrelia afzelii
TSKAINFIQTTEG

SEQ ID NO: 214702 - protein, 13 aa, Borrelia afzelii
SKAINFIQTTEGN

SEQ ID NO: 214703 - protein, 13 aa, Borrelia afzelii
KAINFIQTTEGNL

SEQ ID NO: 214704 - protein, 13 aa, Borrelia afzelii
AINFIQTTEGNLN

SEQ ID NO: 214705 - protein, 13 aa, Borrelia afzelii
INFIQTTEGNLNE

SEQ ID NO: 214706 - protein, 13 aa, Borrelia afzelii
NFIQTTEGNLNEV

SEQ ID NO: 214707 - protein, 13 aa, Borrelia afzelii
FIQTTEGNLNEVE

SEQ ID NO: 214708 - protein, 13 aa, Borrelia afzelii
IQTTEGNLNEVEK

SEQ ID NO: 214709 - protein, 13 aa, Borrelia afzelii
QTTEGNLNEVEKV

SEQ ID NO: 214710 - protein, 13 aa, Borrelia afzelii
TTEGNLNEVEKVL

SEQ ID NO: 214711 - protein, 13 aa, Borrelia afzelii
TEGNLNEVEKVLV

SEQ ID NO: 214712 - protein, 13 aa, Borrelia afzelii
EGNLNEVEKVLVR

SEQ ID NO: 214713 - protein, 13 aa, Borrelia afzelii
GNLNEVEKVLVRM

SEQ ID NO: 214714 - protein, 13 aa, Borrelia afzelii
NLNEVEKVLVRMK

SEQ ID NO: 214715 - protein, 13 aa, Borrelia afzelii
LNEVEKVLVRMKE

SEQ ID NO: 214716 - protein, 13 aa, Borrelia afzelii
NEVEKVLVRMKEL

SEQ ID NO: 214717 - protein, 13 aa, Borrelia afzelii
EVEKVLVRMKELA

SEQ ID NO: 214718 - protein, 13 aa, Borrelia afzelii
VEKVLVRMKELAV

SEQ ID NO: 214719 - protein, 13 aa, Borrelia afzelii
EKVLVRMKELAVQ

SEQ ID NO: 214720 - protein, 13 aa, Borrelia afzelii
KVLVRMKELAVQS

SEQ ID NO: 214721 - protein, 13 aa, Borrelia afzelii
VLVRMKELAVQSG

SEQ ID NO: 214722 - protein, 13 aa, Borrelia afzelii
LVRMKELAVQSGN

SEQ ID NO: 214723 - protein, 13 aa, Borrelia afzelii
VRMKELAVQSGNG

SEQ ID NO: 214724 - protein, 13 aa, Borrelia afzelii
RMKELAVQSGNGT

SEQ ID NO: 214725 - protein, 13 aa, Borrelia afzelii
MKELAVQSGNGTY

SEQ ID NO: 214726 - protein, 13 aa, Borrelia afzelii
KELAVQSGNGTYS

SEQ ID NO: 214727 - protein, 13 aa, Borrelia afzelii
ELAVQSGNGTYSD

SEQ ID NO: 214728 - protein, 13 aa, Borrelia afzelii
LAVQSGNGTYSDS

SEQ ID NO: 214729 - protein, 13 aa, Borrelia afzelii
AVQSGNGTYSDSD

SEQ ID NO: 214730 - protein, 13 aa, Borrelia afzelii
VQSGNGTYSDSDR

SEQ ID NO: 214731 - protein, 13 aa, Borrelia afzelii
QSGNGTYSDSDRG

SEQ ID NO: 214732 - protein, 13 aa, Borrelia afzelii
SGNGTYSDSDRGS

SEQ ID NO: 214733 - protein, 13 aa, Borrelia afzelii
GNGTYSDSDRGSI

SEQ ID NO: 214734 - protein, 13 aa, Borrelia afzelii
NGTYSDSDRGSIQ

SEQ ID NO: 214735 - protein, 13 aa, Borrelia afzelii
GTYSDSDRGSIQI

SEQ ID NO: 214736 - protein, 13 aa, Borrelia afzelii
TYSDSDRGSIQIE

SEQ ID NO: 214737 - protein, 13 aa, Borrelia afzelii
YSDSDRGSIQIEI

SEQ ID NO: 214738 - protein, 13 aa, Borrelia afzelii
SDSDRGSIQIEIE

SEQ ID NO: 214739 - protein, 13 aa, Borrelia afzelii
DSDRGSIQIEIEQ

SEQ ID NO: 214740 - protein, 13 aa, Borrelia afzelii
SDRGSIQIEIEQL

SEQ ID NO: 214741 - protein, 13 aa, Borrelia afzelii
DRGSIQIEIEQLT

SEQ ID NO: 214742 - protein, 13 aa, Borrelia afzelii
RGSIQIEIEQLTD

SEQ ID NO: 214743 - protein, 13 aa, Borrelia afzelii
GSIQIEIEQLTDE

SEQ ID NO: 214744 - protein, 13 aa, Borrelia afzelii
SIQIEIEQLTDEI

SEQ ID NO: 214745 - protein, 13 aa, Borrelia afzelii
IQIEIEQLTDEIN

SEQ ID NO: 214746 - protein, 13 aa, Borrelia afzelii
QIEIEQLTDEINR

SEQ ID NO: 214747 - protein, 13 aa, Borrelia afzelii
IEIEQLTDEINRI

SEQ ID NO: 214748 - protein, 13 aa, Borrelia afzelii
EIEQLTDEINRIA

SEQ ID NO: 214749 - protein, 13 aa, Borrelia afzelii
IEQLTDEINRIAD

SEQ ID NO: 214750 - protein, 13 aa, Borrelia afzelii
EQLTDEINRIADQ

SEQ ID NO: 214751 - protein, 13 aa, Borrelia afzelii
QLTDEINRIADQA

SEQ ID NO: 214752 - protein, 13 aa, Borrelia afzelii
LTDEINRIADQAQ

SEQ ID NO: 214753 - protein, 13 aa, Borrelia afzelii
TDEINRIADQAQY

SEQ ID NO: 214754 - protein, 13 aa, Borrelia afzelii
DEINRIADQAQYN

SEQ ID NO: 214755 - protein, 13 aa, Borrelia afzelii
EINRIADQAQYNQ

SEQ ID NO: 214756 - protein, 13 aa, Borrelia afzelii
INRIADQAQYNQM

SEQ ID NO: 214757 - protein, 13 aa, Borrelia afzelii
NRIADQAQYNQMH

SEQ ID NO: 214758 - protein, 13 aa, Borrelia afzelii
RIADQAQYNQMHM

SEQ ID NO: 214759 - protein, 13 aa, Borrelia afzelii
IADQAQYNQMHML

SEQ ID NO: 214760 - protein, 13 aa, Borrelia afzelii
ADQAQYNQMHMLS

SEQ ID NO: 214761 - protein, 13 aa, Borrelia afzelii
DQAQYNQMHMLSN

SEQ ID NO: 214762 - protein, 13 aa, Borrelia afzelii
QAQYNQMHMLSNK

SEQ ID NO: 214763 - protein, 13 aa, Borrelia afzelii
AQYNQMHMLSNKS

SEQ ID NO: 214764 - protein, 13 aa, Borrelia afzelii
QYNQMHMLSNKSA

SEQ ID NO: 214765 - protein, 13 aa, Borrelia afzelii
YNQMHMLSNKSAS

SEQ ID NO: 214766 - protein, 13 aa, Borrelia afzelii
NQMHMLSNKSASQ

SEQ ID NO: 214767 - protein, 13 aa, Borrelia afzelii
QMHMLSNKSASQN

SEQ ID NO: 214768 - protein, 13 aa, Borrelia afzelii
MHMLSNKSASQNV

SEQ ID NO: 214769 - protein, 13 aa, Borrelia afzelii
HMLSNKSASQNVK

SEQ ID NO: 214770 - protein, 13 aa, Borrelia afzelii
MLSNKSASQNVKT

SEQ ID NO: 214771 - protein, 13 aa, Borrelia afzelii
LSNKSASQNVKTA

SEQ ID NO: 214772 - protein, 13 aa, Borrelia afzelii
SNKSASQNVKTAE

SEQ ID NO: 214773 - protein, 13 aa, Borrelia afzelii
NKSASQNVKTAEE

SEQ ID NO: 214774 - protein, 13 aa, Borrelia afzelii
KSASQNVKTAEEL

SEQ ID NO: 214775 - protein, 13 aa, Borrelia afzelii
SASQNVKTAEELG

SEQ ID NO: 214776 - protein, 13 aa, Borrelia afzelii
ASQNVKTAEELGM

SEQ ID NO: 214777 - protein, 13 aa, Borrelia afzelii
SQNVKTAEELGMQ

SEQ ID NO: 214778 - protein, 13 aa, Borrelia afzelii
QNVKTAEELGMQP

SEQ ID NO: 214779 - protein, 13 aa, Borrelia afzelii
NVKTAEELGMQPA

SEQ ID NO: 214780 - protein, 13 aa, Borrelia afzelii
VKTAEELGMQPAK

SEQ ID NO: 214781 - protein, 13 aa, Borrelia afzelii
KTAEELGMQPAKI

SEQ ID NO: 214782 - protein, 13 aa, Borrelia afzelii
TAEELGMQPAKIN

SEQ ID NO: 214783 - protein, 13 aa, Borrelia afzelii
AEELGMQPAKINT

SEQ ID NO: 214784 - protein, 13 aa, Borrelia afzelii
EELGMQPAKINTP

SEQ ID NO: 214785 - protein, 13 aa, Borrelia afzelii
ELGMQPAKINTPA

SEQ ID NO: 214786 - protein, 13 aa, Borrelia afzelii
LGMQPAKINTPAS

SEQ ID NO: 214787 - protein, 13 aa, Borrelia afzelii
GMQPAKINTPASL

SEQ ID NO: 214788 - protein, 13 aa, Borrelia afzelii
MQPAKINTPASLS

SEQ ID NO: 214789 - protein, 13 aa, Borrelia afzelii
QPAKINTPASLSG

SEQ ID NO: 214790 - protein, 13 aa, Borrelia afzelii
PAKINTPASLSGS

SEQ ID NO: 214791 - protein, 13 aa, Borrelia afzelii
AKINTPASLSGSQ

SEQ ID NO: 214792 - protein, 13 aa, Borrelia afzelii
KINTPASLSGSQA

SEQ ID NO: 214793 - protein, 13 aa, Borrelia afzelii
INTPASLSGSQAS

SEQ ID NO: 214794 - protein, 13 aa, Borrelia afzelii
NTPASLSGSQASW

SEQ ID NO: 214795 - protein, 13 aa, Borrelia afzelii
TPASLSGSQASWT

SEQ ID NO: 214796 - protein, 13 aa, Borrelia afzelii
PASLSGSQASWTL

SEQ ID NO: 214797 - protein, 13 aa, Borrelia afzelii
ASLSGSQASWTLR

SEQ ID NO: 214798 - protein, 13 aa, Borrelia afzelii
SLSGSQASWTLRV

SEQ ID NO: 214799 - protein, 13 aa, Borrelia afzelii
LSGSQASWTLRVH

SEQ ID NO: 214800 - protein, 13 aa, Borrelia afzelii
SGSQASWTLRVHV

SEQ ID NO: 214801 - protein, 13 aa, Borrelia afzelii
GSQASWTLRVHVG

SEQ ID NO: 214802 - protein, 13 aa, Borrelia afzelii
SQASWTLRVHVGA

SEQ ID NO: 214803 - protein, 13 aa, Borrelia afzelii
QASWTLRVHVGAN

SEQ ID NO: 214804 - protein, 13 aa, Borrelia afzelii
ASWTLRVHVGANQ

SEQ ID NO: 214805 - protein, 13 aa, Borrelia afzelii
SWTLRVHVGANQD

SEQ ID NO: 214806 - protein, 13 aa, Borrelia afzelii
WTLRVHVGANQDE

SEQ ID NO: 214807 - protein, 13 aa, Borrelia afzelii
TLRVHVGANQDEA

SEQ ID NO: 214808 - protein, 13 aa, Borrelia afzelii
LRVHVGANQDEAI

SEQ ID NO: 214809 - protein, 13 aa, Borrelia afzelii
RVHVGANQDEAIA

SEQ ID NO: 214810 - protein, 13 aa, Borrelia afzelii
VHVGANQDEAIAV

SEQ ID NO: 214811 - protein, 13 aa, Borrelia afzelii
HVGANQDEAIAVN

SEQ ID NO: 214812 - protein, 13 aa, Borrelia afzelii
VGANQDEAIAVNI

SEQ ID NO: 214813 - protein, 13 aa, Borrelia afzelii
GANQDEAIAVNIY

SEQ ID NO: 214814 - protein, 13 aa, Borrelia afzelii
ANQDEAIAVNIYS

SEQ ID NO: 214815 - protein, 13 aa, Borrelia afzelii
NQDEAIAVNIYSA

SEQ ID NO: 214816 - protein, 13 aa, Borrelia afzelii
QDEAIAVNIYSAN

SEQ ID NO: 214817 - protein, 13 aa, Borrelia afzelii
DEAIAVNIYSANV

SEQ ID NO: 214818 - protein, 13 aa, Borrelia afzelii
EAIAVNIYSANVA

SEQ ID NO: 214819 - protein, 13 aa, Borrelia afzelii
AIAVNIYSANVAN

SEQ ID NO: 214820 - protein, 13 aa, Borrelia afzelii
IAVNIYSANVANL

SEQ ID NO: 214821 - protein, 13 aa, Borrelia afzelii
AVNIYSANVANLF

SEQ ID NO: 214822 - protein, 13 aa, Borrelia afzelii
VNIYSANVANLFA

SEQ ID NO: 214823 - protein, 13 aa, Borrelia afzelii
NIYSANVANLFAG

SEQ ID NO: 214824 - protein, 13 aa, Borrelia afzelii
IYSANVANLFAGE

SEQ ID NO: 214825 - protein, 13 aa, Borrelia afzelii
YSANVANLFAGEG

SEQ ID NO: 214826 - protein, 13 aa, Borrelia afzelii
SANVANLFAGEGA

SEQ ID NO: 214827 - protein, 13 aa, Borrelia afzelii
ANVANLFAGEGAQ

SEQ ID NO: 214828 - protein, 13 aa, Borrelia afzelii
NVANLFAGEGAQA

SEQ ID NO: 214829 - protein, 13 aa, Borrelia afzelii
VANLFAGEGAQAA

SEQ ID NO: 214830 - protein, 13 aa, Borrelia afzelii
ANLFAGEGAQAAQ

SEQ ID NO: 214831 - protein, 13 aa, Borrelia afzelii
NLFAGEGAQAAQA

SEQ ID NO: 214832 - protein, 13 aa, Borrelia afzelii
LFAGEGAQAAQAA

SEQ ID NO: 214833 - protein, 13 aa, Borrelia afzelii
FAGEGAQAAQAAP

SEQ ID NO: 214834 - protein, 13 aa, Borrelia afzelii
AGEGAQAAQAAPV

SEQ ID NO: 214835 - protein, 13 aa, Borrelia afzelii
GEGAQAAQAAPVQ

SEQ ID NO: 214836 - protein, 13 aa, Borrelia afzelii
EGAQAAQAAPVQE

SEQ ID NO: 214837 - protein, 13 aa, Borrelia afzelii
GAQAAQAAPVQEG

SEQ ID NO: 214838 - protein, 13 aa, Borrelia afzelii
AQAAQAAPVQEGA

SEQ ID NO: 214839 - protein, 13 aa, Borrelia afzelii
QAAQAAPVQEGAQ

SEQ ID NO: 214840 - protein, 13 aa, Borrelia afzelii
AAQAAPVQEGAQE

SEQ ID NO: 214841 - protein, 13 aa, Borrelia afzelii
AQAAPVQEGAQEE

SEQ ID NO: 214842 - protein, 13 aa, Borrelia afzelii
QAAPVQEGAQEEG

SEQ ID NO: 214843 - protein, 13 aa, Borrelia afzelii
AAPVQEGAQEEGA

SEQ ID NO: 214844 - protein, 13 aa, Borrelia afzelii
APVQEGAQEEGAQ

SEQ ID NO: 214845 - protein, 13 aa, Borrelia afzelii
PVQEGAQEEGAQQ

SEQ ID NO: 214846 - protein, 13 aa, Borrelia afzelii
VQEGAQEEGAQQP

SEQ ID NO: 214847 - protein, 13 aa, Borrelia afzelii
QEGAQEEGAQQPT

SEQ ID NO: 214848 - protein, 13 aa, Borrelia afzelii
EGAQEEGAQQPTP

SEQ ID NO: 214849 - protein, 13 aa, Borrelia afzelii
GAQEEGAQQPTPA

SEQ ID NO: 214850 - protein, 13 aa, Borrelia afzelii
AQEEGAQQPTPAT

SEQ ID NO: 214851 - protein, 13 aa, Borrelia afzelii
QEEGAQQPTPATA

SEQ ID NO: 214852 - protein, 13 aa, Borrelia afzelii
EEGAQQPTPATAP

SEQ ID NO: 214853 - protein, 13 aa, Borrelia afzelii
EGAQQPTPATAPT

SEQ ID NO: 214854 - protein, 13 aa, Borrelia afzelii
GAQQPTPATAPTQ

SEQ ID NO: 214855 - protein, 13 aa, Borrelia afzelii
AQQPTPATAPTQG

SEQ ID NO: 214856 - protein, 13 aa, Borrelia afzelii
QQPTPATAPTQGG

SEQ ID NO: 214857 - protein, 13 aa, Borrelia afzelii
QPTPATAPTQGGV

SEQ ID NO: 214858 - protein, 13 aa, Borrelia afzelii
PTPATAPTQGGVN

SEQ ID NO: 214859 - protein, 13 aa, Borrelia afzelii
TPATAPTQGGVNS

SEQ ID NO: 214860 - protein, 13 aa, Borrelia afzelii
PATAPTQGGVNSP

SEQ ID NO: 214861 - protein, 13 aa, Borrelia afzelii
ATAPTQGGVNSPV

SEQ ID NO: 214862 - protein, 13 aa, Borrelia afzelii
TAPTQGGVNSPVN

SEQ ID NO: 214863 - protein, 13 aa, Borrelia afzelii
APTQGGVNSPVNV

SEQ ID NO: 214864 - protein, 13 aa, Borrelia afzelii
PTQGGVNSPVNVT

SEQ ID NO: 214865 - protein, 13 aa, Borrelia afzelii
TQGGVNSPVNVTT

SEQ ID NO: 214866 - protein, 13 aa, Borrelia afzelii
QGGVNSPVNVTTT

SEQ ID NO: 214867 - protein, 13 aa, Borrelia afzelii
GGVNSPVNVTTTV

SEQ ID NO: 214868 - protein, 13 aa, Borrelia afzelii
GVNSPVNVTTTVD

SEQ ID NO: 214869 - protein, 13 aa, Borrelia afzelii
VNSPVNVTTTVDA

SEQ ID NO: 214870 - protein, 13 aa, Borrelia afzelii
NSPVNVTTTVDAN

SEQ ID NO: 214871 - protein, 13 aa, Borrelia afzelii
SPVNVTTTVDANT

SEQ ID NO: 214872 - protein, 13 aa, Borrelia afzelii
PVNVTTTVDANTS

SEQ ID NO: 214873 - protein, 13 aa, Borrelia afzelii
VNVTTTVDANTSL

SEQ ID NO: 214874 - protein, 13 aa, Borrelia afzelii
NVTTTVDANTSLA

SEQ ID NO: 214875 - protein, 13 aa, Borrelia afzelii
VTTTVDANTSLAK

SEQ ID NO: 214876 - protein, 13 aa, Borrelia afzelii
TTTVDANTSLAKI

SEQ ID NO: 214877 - protein, 13 aa, Borrelia afzelii
TTVDANTSLAKIE

SEQ ID NO: 214878 - protein, 13 aa, Borrelia afzelii
TVDANTSLAKIEN

SEQ ID NO: 214879 - protein, 13 aa, Borrelia afzelii
VDANTSLAKIENA

SEQ ID NO: 214880 - protein, 13 aa, Borrelia afzelii
DANTSLAKIENAI

SEQ ID NO: 214881 - protein, 13 aa, Borrelia afzelii
ANTSLAKIENAIR

SEQ ID NO: 214882 - protein, 13 aa, Borrelia afzelii
NTSLAKIENAIRM

SEQ ID NO: 214883 - protein, 13 aa, Borrelia afzelii
TSLAKIENAIRMI

SEQ ID NO: 214884 - protein, 13 aa, Borrelia afzelii
SLAKIENAIRMIS

SEQ ID NO: 214885 - protein, 13 aa, Borrelia afzelii
LAKIENAIRMISD

SEQ ID NO: 214886 - protein, 13 aa, Borrelia afzelii
AKIENAIRMISDQ

SEQ ID NO: 214887 - protein, 13 aa, Borrelia afzelii
KIENAIRMISDQR

SEQ ID NO: 214888 - protein, 13 aa, Borrelia afzelii
IENAIRMISDQRA

SEQ ID NO: 214889 - protein, 13 aa, Borrelia afzelii
ENAIRMISDQRAN

SEQ ID NO: 214890 - protein, 13 aa, Borrelia afzelii
NAIRMISDQRANL

SEQ ID NO: 214891 - protein, 13 aa, Borrelia afzelii
AIRMISDQRANLG

SEQ ID NO: 214892 - protein, 13 aa, Borrelia afzelii
IRMISDQRANLGA

SEQ ID NO: 214893 - protein, 13 aa, Borrelia afzelii
RMISDQRANLGAF

SEQ ID NO: 214894 - protein, 13 aa, Borrelia afzelii
MISDQRANLGAFQ

SEQ ID NO: 214895 - protein, 13 aa, Borrelia afzelii
ISDQRANLGAFQN

SEQ ID NO: 214896 - protein, 13 aa, Borrelia afzelii
SDQRANLGAFQNR

SEQ ID NO: 214897 - protein, 13 aa, Borrelia afzelii
DQRANLGAFQNRL

SEQ ID NO: 214898 - protein, 13 aa, Borrelia afzelii
QRANLGAFQNRLE

SEQ ID NO: 214899 - protein, 13 aa, Borrelia afzelii
RANLGAFQNRLES

SEQ ID NO: 214900 - protein, 13 aa, Borrelia afzelii
ANLGAFQNRLESI

SEQ ID NO: 214901 - protein, 13 aa, Borrelia afzelii
NLGAFQNRLESIK

SEQ ID NO: 214902 - protein, 13 aa, Borrelia afzelii
LGAFQNRLESIKN

SEQ ID NO: 214903 - protein, 13 aa, Borrelia afzelii
GAFQNRLESIKNS

SEQ ID NO: 214904 - protein, 13 aa, Borrelia afzelii
AFQNRLESIKNST

SEQ ID NO: 214905 - protein, 13 aa, Borrelia afzelii
FQNRLESIKNSTE

SEQ ID NO: 214906 - protein, 13 aa, Borrelia afzelii
QNRLESIKNSTEY

SEQ ID NO: 214907 - protein, 13 aa, Borrelia afzelii
NRLESIKNSTEYA

SEQ ID NO: 214908 - protein, 13 aa, Borrelia afzelii
RLESIKNSTEYAI

SEQ ID NO: 214909 - protein, 13 aa, Borrelia afzelii
LESIKNSTEYAIE

SEQ ID NO: 214910 - protein, 13 aa, Borrelia afzelii
ESIKNSTEYAIEN

SEQ ID NO: 214911 - protein, 13 aa, Borrelia afzelii
SIKNSTEYAIENL

SEQ ID NO: 214912 - protein, 13 aa, Borrelia afzelii
IKNSTEYAIENLK

SEQ ID NO: 214913 - protein, 13 aa, Borrelia afzelii
KNSTEYAIENLKA

SEQ ID NO: 214914 - protein, 13 aa, Borrelia afzelii
NSTEYAIENLKAS

SEQ ID NO: 214915 - protein, 13 aa, Borrelia afzelii
STEYAIENLKASY

SEQ ID NO: 214916 - protein, 13 aa, Borrelia afzelii
TEYAIENLKASYA

SEQ ID NO: 214917 - protein, 13 aa, Borrelia afzelii
EYAIENLKASYAQ

SEQ ID NO: 214918 - protein, 13 aa, Borrelia afzelii
YAIENLKASYAQI

SEQ ID NO: 214919 - protein, 13 aa, Borrelia afzelii
AIENLKASYAQIK

SEQ ID NO: 214920 - protein, 13 aa, Borrelia afzelii
IENLKASYAQIKD

SEQ ID NO: 214921 - protein, 13 aa, Borrelia afzelii
ENLKASYAQIKDA

SEQ ID NO: 214922 - protein, 13 aa, Borrelia afzelii
NLKASYAQIKDAT

SEQ ID NO: 214923 - protein, 13 aa, Borrelia afzelii
LKASYAQIKDATM

SEQ ID NO: 214924 - protein, 13 aa, Borrelia afzelii
KASYAQIKDATMT

SEQ ID NO: 214925 - protein, 13 aa, Borrelia afzelii
ASYAQIKDATMTD

SEQ ID NO: 214926 - protein, 13 aa, Borrelia afzelii
SYAQIKDATMTDE

SEQ ID NO: 214927 - protein, 13 aa, Borrelia afzelii
YAQIKDATMTDEV

SEQ ID NO: 214928 - protein, 13 aa, Borrelia afzelii
AQIKDATMTDEVV

SEQ ID NO: 214929 - protein, 13 aa, Borrelia afzelii
QIKDATMTDEVVA

SEQ ID NO: 214930 - protein, 13 aa, Borrelia afzelii
IKDATMTDEVVAA

SEQ ID NO: 214931 - protein, 13 aa, Borrelia afzelii
KDATMTDEVVAAT

SEQ ID NO: 214932 - protein, 13 aa, Borrelia afzelii
DATMTDEVVAATT

SEQ ID NO: 214933 - protein, 13 aa, Borrelia afzelii
ATMTDEVVAATTN

SEQ ID NO: 214934 - protein, 13 aa, Borrelia afzelii
TMTDEVVAATTNS

SEQ ID NO: 214935 - protein, 13 aa, Borrelia afzelii
MTDEVVAATTNSI

SEQ ID NO: 214936 - protein, 13 aa, Borrelia afzelii
TDEVVAATTNSIL

SEQ ID NO: 214937 - protein, 13 aa, Borrelia afzelii
DEVVAATTNSILT

SEQ ID NO: 214938 - protein, 13 aa, Borrelia afzelii
EVVAATTNSILTQ

SEQ ID NO: 214939 - protein, 13 aa, Borrelia afzelii
VVAATTNSILTQS

SEQ ID NO: 214940 - protein, 13 aa, Borrelia afzelii
VAATTNSILTQSA

SEQ ID NO: 214941 - protein, 13 aa, Borrelia afzelii
AATTNSILTQSAM

SEQ ID NO: 214942 - protein, 13 aa, Borrelia afzelii
ATTNSILTQSAMA

SEQ ID NO: 214943 - protein, 13 aa, Borrelia afzelii
TTNSILTQSAMAM

SEQ ID NO: 214944 - protein, 13 aa, Borrelia afzelii
TNSILTQSAMAMI

SEQ ID NO: 214945 - protein, 13 aa, Borrelia afzelii
NSILTQSAMAMIA

SEQ ID NO: 214946 - protein, 13 aa, Borrelia afzelii
SILTQSAMAMIAQ

SEQ ID NO: 214947 - protein, 13 aa, Borrelia afzelii
ILTQSAMAMIAQA

SEQ ID NO: 214948 - protein, 13 aa, Borrelia afzelii
LTQSAMAMIAQAN

SEQ ID NO: 214949 - protein, 13 aa, Borrelia afzelii
TQSAMAMIAQANQ

SEQ ID NO: 214950 - protein, 13 aa, Borrelia afzelii
QSAMAMIAQANQV

SEQ ID NO: 214951 - protein, 13 aa, Borrelia afzelii
SAMAMIAQANQVP

SEQ ID NO: 214952 - protein, 13 aa, Borrelia afzelii
AMAMIAQANQVPQ

SEQ ID NO: 214953 - protein, 13 aa, Borrelia afzelii
MAMIAQANQVPQY

SEQ ID NO: 214954 - protein, 13 aa, Borrelia afzelii
AMIAQANQVPQYV

SEQ ID NO: 214955 - protein, 13 aa, Borrelia afzelii
MIAQANQVPQYVL

SEQ ID NO: 214956 - protein, 13 aa, Borrelia afzelii
IAQANQVPQYVLS

SEQ ID NO: 214957 - protein, 13 aa, Borrelia afzelii
AQANQVPQYVLSL

SEQ ID NO: 214958 - protein, 13 aa, Borrelia afzelii
QANQVPQYVLSLL

SEQ ID NO: 214959 - protein, 13 aa, Borrelia afzelii
ANQVPQYVLSLLR

SEQ ID NO: 214960 - protein, 14 aa, Borrelia afzelii
MIINHNTSAINASR

SEQ ID NO: 214961 - protein, 14 aa, Borrelia afzelii
IINHNTSAINASRN

SEQ ID NO: 214962 - protein, 14 aa, Borrelia afzelii
INHNTSAINASRNN

SEQ ID NO: 214963 - protein, 14 aa, Borrelia afzelii
NHNTSAINASRNNA

SEQ ID NO: 214964 - protein, 14 aa, Borrelia afzelii
HNTSAINASRNNAI

SEQ ID NO: 214965 - protein, 14 aa, Borrelia afzelii
NTSAINASRNNAIN

SEQ ID NO: 214966 - protein, 14 aa, Borrelia afzelii
TSAINASRNNAINA

SEQ ID NO: 214967 - protein, 14 aa, Borrelia afzelii
SAINASRNNAINAA

SEQ ID NO: 214968 - protein, 14 aa, Borrelia afzelii
AINASRNNAINAAN

SEQ ID NO: 214969 - protein, 14 aa, Borrelia afzelii
INASRNNAINAANL

SEQ ID NO: 214970 - protein, 14 aa, Borrelia afzelii
NASRNNAINAANLS

SEQ ID NO: 214971 - protein, 14 aa, Borrelia afzelii
ASRNNAINAANLSK

SEQ ID NO: 214972 - protein, 14 aa, Borrelia afzelii
SRNNAINAANLSKT

SEQ ID NO: 214973 - protein, 14 aa, Borrelia afzelii
RNNAINAANLSKTQ

SEQ ID NO: 214974 - protein, 14 aa, Borrelia afzelii
NNAINAANLSKTQE

SEQ ID NO: 214975 - protein, 14 aa, Borrelia afzelii
NAINAANLSKTQEK

SEQ ID NO: 214976 - protein, 14 aa, Borrelia afzelii
AINAANLSKTQEKL

SEQ ID NO: 214977 - protein, 14 aa, Borrelia afzelii
INAANLSKTQEKLS

SEQ ID NO: 214978 - protein, 14 aa, Borrelia afzelii
NAANLSKTQEKLSS

SEQ ID NO: 214979 - protein, 14 aa, Borrelia afzelii
AANLSKTQEKLSSG

SEQ ID NO: 214980 - protein, 14 aa, Borrelia afzelii
ANLSKTQEKLSSGY

SEQ ID NO: 214981 - protein, 14 aa, Borrelia afzelii
NLSKTQEKLSSGYR

SEQ ID NO: 214982 - protein, 14 aa, Borrelia afzelii
LSKTQEKLSSGYRI

SEQ ID NO: 214983 - protein, 14 aa, Borrelia afzelii
SKTQEKLSSGYRIN

SEQ ID NO: 214984 - protein, 14 aa, Borrelia afzelii
KTQEKLSSGYRINR

SEQ ID NO: 214985 - protein, 14 aa, Borrelia afzelii
TQEKLSSGYRINRA

SEQ ID NO: 214986 - protein, 14 aa, Borrelia afzelii
QEKLSSGYRINRAS

SEQ ID NO: 214987 - protein, 14 aa, Borrelia afzelii
EKLSSGYRINRASD

SEQ ID NO: 214988 - protein, 14 aa, Borrelia afzelii
KLSSGYRINRASDD

SEQ ID NO: 214989 - protein, 14 aa, Borrelia afzelii
LSSGYRINRASDDA

SEQ ID NO: 214990 - protein, 14 aa, Borrelia afzelii
SSGYRINRASDDAA

SEQ ID NO: 214991 - protein, 14 aa, Borrelia afzelii
SGYRINRASDDAAG

SEQ ID NO: 214992 - protein, 14 aa, Borrelia afzelii
GYRINRASDDAAGM

SEQ ID NO: 214993 - protein, 14 aa, Borrelia afzelii
YRINRASDDAAGMG

SEQ ID NO: 214994 - protein, 14 aa, Borrelia afzelii
RINRASDDAAGMGV

SEQ ID NO: 214995 - protein, 14 aa, Borrelia afzelii
INRASDDAAGMGVS

SEQ ID NO: 214996 - protein, 14 aa, Borrelia afzelii
NRASDDAAGMGVSG

SEQ ID NO: 214997 - protein, 14 aa, Borrelia afzelii
RASDDAAGMGVSGK

SEQ ID NO: 214998 - protein, 14 aa, Borrelia afzelii
ASDDAAGMGVSGKI

SEQ ID NO: 214999 - protein, 14 aa, Borrelia afzelii
SDDAAGMGVSGKIN

SEQ ID NO: 215000 - protein, 14 aa, Borrelia afzelii
DDAAGMGVSGKINA

SEQ ID NO: 215001 - protein, 14 aa, Borrelia afzelii
DAAGMGVSGKINAQ

SEQ ID NO: 215002 - protein, 14 aa, Borrelia afzelii
AAGMGVSGKINAQI

SEQ ID NO: 215003 - protein, 14 aa, Borrelia afzelii
AGMGVSGKINAQIR

SEQ ID NO: 215004 - protein, 14 aa, Borrelia afzelii
GMGVSGKINAQIRG

SEQ ID NO: 215005 - protein, 14 aa, Borrelia afzelii
MGVSGKINAQIRGL

SEQ ID NO: 215006 - protein, 14 aa, Borrelia afzelii
GVSGKINAQIRGLS

SEQ ID NO: 215007 - protein, 14 aa, Borrelia afzelii
VSGKINAQIRGLSQ

SEQ ID NO: 215008 - protein, 14 aa, Borrelia afzelii
SGKINAQIRGLSQA

SEQ ID NO: 215009 - protein, 14 aa, Borrelia afzelii
GKINAQIRGLSQAS

SEQ ID NO: 215010 - protein, 14 aa, Borrelia afzelii
KINAQIRGLSQASR

SEQ ID NO: 215011 - protein, 14 aa, Borrelia afzelii
INAQIRGLSQASRN

SEQ ID NO: 215012 - protein, 14 aa, Borrelia afzelii
NAQIRGLSQASRNT

SEQ ID NO: 215013 - protein, 14 aa, Borrelia afzelii
AQIRGLSQASRNTS

SEQ ID NO: 215014 - protein, 14 aa, Borrelia afzelii
QIRGLSQASRNTSK

SEQ ID NO: 215015 - protein, 14 aa, Borrelia afzelii
IRGLSQASRNTSKA

SEQ ID NO: 215016 - protein, 14 aa, Borrelia afzelii
RGLSQASRNTSKAI

SEQ ID NO: 215017 - protein, 14 aa, Borrelia afzelii
GLSQASRNTSKAIN

SEQ ID NO: 215018 - protein, 14 aa, Borrelia afzelii
LSQASRNTSKAINF

SEQ ID NO: 215019 - protein, 14 aa, Borrelia afzelii
SQASRNTSKAINFI

SEQ ID NO: 215020 - protein, 14 aa, Borrelia afzelii
QASRNTSKAINFIQ

SEQ ID NO: 215021 - protein, 14 aa, Borrelia afzelii
ASRNTSKAINFIQT

SEQ ID NO: 215022 - protein, 14 aa, Borrelia afzelii
SRNTSKAINFIQTT

SEQ ID NO: 215023 - protein, 14 aa, Borrelia afzelii
RNTSKAINFIQTTE

SEQ ID NO: 215024 - protein, 14 aa, Borrelia afzelii
NTSKAINFIQTTEG

SEQ ID NO: 215025 - protein, 14 aa, Borrelia afzelii
TSKAINFIQTTEGN

SEQ ID NO: 215026 - protein, 14 aa, Borrelia afzelii
SKAINFIQTTEGNL

SEQ ID NO: 215027 - protein, 14 aa, Borrelia afzelii
KAINFIQTTEGNLN

SEQ ID NO: 215028 - protein, 14 aa, Borrelia afzelii
AINFIQTTEGNLNE

SEQ ID NO: 215029 - protein, 14 aa, Borrelia afzelii
INFIQTTEGNLNEV

SEQ ID NO: 215030 - protein, 14 aa, Borrelia afzelii
NFIQTTEGNLNEVE

SEQ ID NO: 215031 - protein, 14 aa, Borrelia afzelii
FIQTTEGNLNEVEK

SEQ ID NO: 215032 - protein, 14 aa, Borrelia afzelii
IQTTEGNLNEVEKV

SEQ ID NO: 215033 - protein, 14 aa, Borrelia afzelii
QTTEGNLNEVEKVL

SEQ ID NO: 215034 - protein, 14 aa, Borrelia afzelii
TTEGNLNEVEKVLV

SEQ ID NO: 215035 - protein, 14 aa, Borrelia afzelii
TEGNLNEVEKVLVR

SEQ ID NO: 215036 - protein, 14 aa, Borrelia afzelii
EGNLNEVEKVLVRM

SEQ ID NO: 215037 - protein, 14 aa, Borrelia afzelii
GNLNEVEKVLVRMK

SEQ ID NO: 215038 - protein, 14 aa, Borrelia afzelii
NLNEVEKVLVRMKE

SEQ ID NO: 215039 - protein, 14 aa, Borrelia afzelii
LNEVEKVLVRMKEL

SEQ ID NO: 215040 - protein, 14 aa, Borrelia afzelii
NEVEKVLVRMKELA

SEQ ID NO: 215041 - protein, 14 aa, Borrelia afzelii
EVEKVLVRMKELAV

SEQ ID NO: 215042 - protein, 14 aa, Borrelia afzelii
VEKVLVRMKELAVQ

SEQ ID NO: 215043 - protein, 14 aa, Borrelia afzelii
EKVLVRMKELAVQS

SEQ ID NO: 215044 - protein, 14 aa, Borrelia afzelii
KVLVRMKELAVQSG

SEQ ID NO: 215045 - protein, 14 aa, Borrelia afzelii
VLVRMKELAVQSGN

SEQ ID NO: 215046 - protein, 14 aa, Borrelia afzelii
LVRMKELAVQSGNG

SEQ ID NO: 215047 - protein, 14 aa, Borrelia afzelii
VRMKELAVQSGNGT

SEQ ID NO: 215048 - protein, 14 aa, Borrelia afzelii
RMKELAVQSGNGTY

SEQ ID NO: 215049 - protein, 14 aa, Borrelia afzelii
MKELAVQSGNGTYS

SEQ ID NO: 215050 - protein, 14 aa, Borrelia afzelii
KELAVQSGNGTYSD

SEQ ID NO: 215051 - protein, 14 aa, Borrelia afzelii
ELAVQSGNGTYSDS

SEQ ID NO: 215052 - protein, 14 aa, Borrelia afzelii
LAVQSGNGTYSDSD

SEQ ID NO: 215053 - protein, 14 aa, Borrelia afzelii
AVQSGNGTYSDSDR

SEQ ID NO: 215054 - protein, 14 aa, Borrelia afzelii
VQSGNGTYSDSDRG

SEQ ID NO: 215055 - protein, 14 aa, Borrelia afzelii
QSGNGTYSDSDRGS

SEQ ID NO: 215056 - protein, 14 aa, Borrelia afzelii
SGNGTYSDSDRGSI

SEQ ID NO: 215057 - protein, 14 aa, Borrelia afzelii
GNGTYSDSDRGSIQ

SEQ ID NO: 215058 - protein, 14 aa, Borrelia afzelii
NGTYSDSDRGSIQI

SEQ ID NO: 215059 - protein, 14 aa, Borrelia afzelii
GTYSDSDRGSIQIE

SEQ ID NO: 215060 - protein, 14 aa, Borrelia afzelii
TYSDSDRGSIQIEI

SEQ ID NO: 215061 - protein, 14 aa, Borrelia afzelii
YSDSDRGSIQIEIE

SEQ ID NO: 215062 - protein, 14 aa, Borrelia afzelii
SDSDRGSIQIEIEQ

SEQ ID NO: 215063 - protein, 14 aa, Borrelia afzelii
DSDRGSIQIEIEQL

SEQ ID NO: 215064 - protein, 14 aa, Borrelia afzelii
SDRGSIQIEIEQLT

SEQ ID NO: 215065 - protein, 14 aa, Borrelia afzelii
DRGSIQIEIEQLTD

SEQ ID NO: 215066 - protein, 14 aa, Borrelia afzelii
RGSIQIEIEQLTDE

SEQ ID NO: 215067 - protein, 14 aa, Borrelia afzelii
GSIQIEIEQLTDEI

SEQ ID NO: 215068 - protein, 14 aa, Borrelia afzelii
SIQIEIEQLTDEIN

SEQ ID NO: 215069 - protein, 14 aa, Borrelia afzelii
IQIEIEQLTDEINR

SEQ ID NO: 215070 - protein, 14 aa, Borrelia afzelii
QIEIEQLTDEINRI

SEQ ID NO: 215071 - protein, 14 aa, Borrelia afzelii
IEIEQLTDEINRIA

SEQ ID NO: 215072 - protein, 14 aa, Borrelia afzelii
EIEQLTDEINRIAD

SEQ ID NO: 215073 - protein, 14 aa, Borrelia afzelii
IEQLTDEINRIADQ

SEQ ID NO: 215074 - protein, 14 aa, Borrelia afzelii
EQLTDEINRIADQA

SEQ ID NO: 215075 - protein, 14 aa, Borrelia afzelii
QLTDEINRIADQAQ

SEQ ID NO: 215076 - protein, 14 aa, Borrelia afzelii
LTDEINRIADQAQY

SEQ ID NO: 215077 - protein, 14 aa, Borrelia afzelii
TDEINRIADQAQYN

SEQ ID NO: 215078 - protein, 14 aa, Borrelia afzelii
DEINRIADQAQYNQ

SEQ ID NO: 215079 - protein, 14 aa, Borrelia afzelii
EINRIADQAQYNQM

SEQ ID NO: 215080 - protein, 14 aa, Borrelia afzelii
INRIADQAQYNQMH

SEQ ID NO: 215081 - protein, 14 aa, Borrelia afzelii
NRIADQAQYNQMHM

SEQ ID NO: 215082 - protein, 14 aa, Borrelia afzelii
RIADQAQYNQMHML

SEQ ID NO: 215083 - protein, 14 aa, Borrelia afzelii
IADQAQYNQMHMLS

SEQ ID NO: 215084 - protein, 14 aa, Borrelia afzelii
ADQAQYNQMHMLSN

SEQ ID NO: 215085 - protein, 14 aa, Borrelia afzelii
DQAQYNQMHMLSNK

SEQ ID NO: 215086 - protein, 14 aa, Borrelia afzelii
QAQYNQMHMLSNKS

SEQ ID NO: 215087 - protein, 14 aa, Borrelia afzelii
AQYNQMHMLSNKSA

SEQ ID NO: 215088 - protein, 14 aa, Borrelia afzelii
QYNQMHMLSNKSAS

SEQ ID NO: 215089 - protein, 14 aa, Borrelia afzelii
YNQMHMLSNKSASQ

SEQ ID NO: 215090 - protein, 14 aa, Borrelia afzelii
NQMHMLSNKSASQN

SEQ ID NO: 215091 - protein, 14 aa, Borrelia afzelii
QMHMLSNKSASQNV

SEQ ID NO: 215092 - protein, 14 aa, Borrelia afzelii
MHMLSNKSASQNVK

SEQ ID NO: 215093 - protein, 14 aa, Borrelia afzelii
HMLSNKSASQNVKT

SEQ ID NO: 215094 - protein, 14 aa, Borrelia afzelii
MLSNKSASQNVKTA

SEQ ID NO: 215095 - protein, 14 aa, Borrelia afzelii
LSNKSASQNVKTAE

SEQ ID NO: 215096 - protein, 14 aa, Borrelia afzelii
SNKSASQNVKTAEE

SEQ ID NO: 215097 - protein, 14 aa, Borrelia afzelii
NKSASQNVKTAEEL

SEQ ID NO: 215098 - protein, 14 aa, Borrelia afzelii
KSASQNVKTAEELG

SEQ ID NO: 215099 - protein, 14 aa, Borrelia afzelii
SASQNVKTAEELGM

SEQ ID NO: 215100 - protein, 14 aa, Borrelia afzelii
ASQNVKTAEELGMQ

SEQ ID NO: 215101 - protein, 14 aa, Borrelia afzelii
SQNVKTAEELGMQP

SEQ ID NO: 215102 - protein, 14 aa, Borrelia afzelii
QNVKTAEELGMQPA

SEQ ID NO: 215103 - protein, 14 aa, Borrelia afzelii
NVKTAEELGMQPAK

SEQ ID NO: 215104 - protein, 14 aa, Borrelia afzelii
VKTAEELGMQPAKI

SEQ ID NO: 215105 - protein, 14 aa, Borrelia afzelii
KTAEELGMQPAKIN

SEQ ID NO: 215106 - protein, 14 aa, Borrelia afzelii
TAEELGMQPAKINT

SEQ ID NO: 215107 - protein, 14 aa, Borrelia afzelii
AEELGMQPAKINTP

SEQ ID NO: 215108 - protein, 14 aa, Borrelia afzelii
EELGMQPAKINTPA

SEQ ID NO: 215109 - protein, 14 aa, Borrelia afzelii
ELGMQPAKINTPAS

SEQ ID NO: 215110 - protein, 14 aa, Borrelia afzelii
LGMQPAKINTPASL

SEQ ID NO: 215111 - protein, 14 aa, Borrelia afzelii
GMQPAKINTPASLS

SEQ ID NO: 215112 - protein, 14 aa, Borrelia afzelii
MQPAKINTPASLSG

SEQ ID NO: 215113 - protein, 14 aa, Borrelia afzelii
QPAKINTPASLSGS

SEQ ID NO: 215114 - protein, 14 aa, Borrelia afzelii
PAKINTPASLSGSQ

SEQ ID NO: 215115 - protein, 14 aa, Borrelia afzelii
AKINTPASLSGSQA

SEQ ID NO: 215116 - protein, 14 aa, Borrelia afzelii
KINTPASLSGSQAS

SEQ ID NO: 215117 - protein, 14 aa, Borrelia afzelii
INTPASLSGSQASW

SEQ ID NO: 215118 - protein, 14 aa, Borrelia afzelii
NTPASLSGSQASWT

SEQ ID NO: 215119 - protein, 14 aa, Borrelia afzelii
TPASLSGSQASWTL

SEQ ID NO: 215120 - protein, 14 aa, Borrelia afzelii
PASLSGSQASWTLR

SEQ ID NO: 215121 - protein, 14 aa, Borrelia afzelii
ASLSGSQASWTLRV

SEQ ID NO: 215122 - protein, 14 aa, Borrelia afzelii
SLSGSQASWTLRVH

SEQ ID NO: 215123 - protein, 14 aa, Borrelia afzelii
LSGSQASWTLRVHV

SEQ ID NO: 215124 - protein, 14 aa, Borrelia afzelii
SGSQASWTLRVHVG

SEQ ID NO: 215125 - protein, 14 aa, Borrelia afzelii
GSQASWTLRVHVGA

SEQ ID NO: 215126 - protein, 14 aa, Borrelia afzelii
SQASWTLRVHVGAN

SEQ ID NO: 215127 - protein, 14 aa, Borrelia afzelii
QASWTLRVHVGANQ

SEQ ID NO: 215128 - protein, 14 aa, Borrelia afzelii
ASWTLRVHVGANQD

SEQ ID NO: 215129 - protein, 14 aa, Borrelia afzelii
SWTLRVHVGANQDE

SEQ ID NO: 215130 - protein, 14 aa, Borrelia afzelii
WTLRVHVGANQDEA

SEQ ID NO: 215131 - protein, 14 aa, Borrelia afzelii
TLRVHVGANQDEAI

SEQ ID NO: 215132 - protein, 14 aa, Borrelia afzelii
LRVHVGANQDEAIA

SEQ ID NO: 215133 - protein, 14 aa, Borrelia afzelii
RVHVGANQDEAIAV

SEQ ID NO: 215134 - protein, 14 aa, Borrelia afzelii
VHVGANQDEAIAVN

SEQ ID NO: 215135 - protein, 14 aa, Borrelia afzelii
HVGANQDEAIAVNI

SEQ ID NO: 215136 - protein, 14 aa, Borrelia afzelii
VGANQDEAIAVNIY

SEQ ID NO: 215137 - protein, 14 aa, Borrelia afzelii
GANQDEAIAVNIYS

SEQ ID NO: 215138 - protein, 14 aa, Borrelia afzelii
ANQDEAIAVNIYSA

SEQ ID NO: 215139 - protein, 14 aa, Borrelia afzelii
NQDEAIAVNIYSAN

SEQ ID NO: 215140 - protein, 14 aa, Borrelia afzelii
QDEAIAVNIYSANV

SEQ ID NO: 215141 - protein, 14 aa, Borrelia afzelii
DEAIAVNIYSANVA

SEQ ID NO: 215142 - protein, 14 aa, Borrelia afzelii
EAIAVNIYSANVAN

SEQ ID NO: 215143 - protein, 14 aa, Borrelia afzelii
AIAVNIYSANVANL

SEQ ID NO: 215144 - protein, 14 aa, Borrelia afzelii
IAVNIYSANVANLF

SEQ ID NO: 215145 - protein, 14 aa, Borrelia afzelii
AVNIYSANVANLFA

SEQ ID NO: 215146 - protein, 14 aa, Borrelia afzelii
VNIYSANVANLFAG

SEQ ID NO: 215147 - protein, 14 aa, Borrelia afzelii
NIYSANVANLFAGE

SEQ ID NO: 215148 - protein, 14 aa, Borrelia afzelii
IYSANVANLFAGEG

SEQ ID NO: 215149 - protein, 14 aa, Borrelia afzelii
YSANVANLFAGEGA

SEQ ID NO: 215150 - protein, 14 aa, Borrelia afzelii
SANVANLFAGEGAQ

SEQ ID NO: 215151 - protein, 14 aa, Borrelia afzelii
ANVANLFAGEGAQA

SEQ ID NO: 215152 - protein, 14 aa, Borrelia afzelii
NVANLFAGEGAQAA

SEQ ID NO: 215153 - protein, 14 aa, Borrelia afzelii
VANLFAGEGAQAAQ

SEQ ID NO: 215154 - protein, 14 aa, Borrelia afzelii
ANLFAGEGAQAAQA

SEQ ID NO: 215155 - protein, 14 aa, Borrelia afzelii
NLFAGEGAQAAQAA

SEQ ID NO: 215156 - protein, 14 aa, Borrelia afzelii
LFAGEGAQAAQAAP

SEQ ID NO: 215157 - protein, 14 aa, Borrelia afzelii
FAGEGAQAAQAAPV

SEQ ID NO: 215158 - protein, 14 aa, Borrelia afzelii
AGEGAQAAQAAPVQ

SEQ ID NO: 215159 - protein, 14 aa, Borrelia afzelii
GEGAQAAQAAPVQE

SEQ ID NO: 215160 - protein, 14 aa, Borrelia afzelii
EGAQAAQAAPVQEG

SEQ ID NO: 215161 - protein, 14 aa, Borrelia afzelii
GAQAAQAAPVQEGA

SEQ ID NO: 215162 - protein, 14 aa, Borrelia afzelii
AQAAQAAPVQEGAQ

SEQ ID NO: 215163 - protein, 14 aa, Borrelia afzelii
QAAQAAPVQEGAQE

SEQ ID NO: 215164 - protein, 14 aa, Borrelia afzelii
AAQAAPVQEGAQEE

SEQ ID NO: 215165 - protein, 14 aa, Borrelia afzelii
AQAAPVQEGAQEEG

SEQ ID NO: 215166 - protein, 14 aa, Borrelia afzelii
QAAPVQEGAQEEGA

SEQ ID NO: 215167 - protein, 14 aa, Borrelia afzelii
AAPVQEGAQEEGAQ

SEQ ID NO: 215168 - protein, 14 aa, Borrelia afzelii
APVQEGAQEEGAQQ

SEQ ID NO: 215169 - protein, 14 aa, Borrelia afzelii
PVQEGAQEEGAQQP

SEQ ID NO: 215170 - protein, 14 aa, Borrelia afzelii
VQEGAQEEGAQQPT

SEQ ID NO: 215171 - protein, 14 aa, Borrelia afzelii
QEGAQEEGAQQPTP

SEQ ID NO: 215172 - protein, 14 aa, Borrelia afzelii
EGAQEEGAQQPTPA

SEQ ID NO: 215173 - protein, 14 aa, Borrelia afzelii
GAQEEGAQQPTPAT

SEQ ID NO: 215174 - protein, 14 aa, Borrelia afzelii
AQEEGAQQPTPATA

SEQ ID NO: 215175 - protein, 14 aa, Borrelia afzelii
QEEGAQQPTPATAP

SEQ ID NO: 215176 - protein, 14 aa, Borrelia afzelii
EEGAQQPTPATAPT

SEQ ID NO: 215177 - protein, 14 aa, Borrelia afzelii
EGAQQPTPATAPTQ

SEQ ID NO: 215178 - protein, 14 aa, Borrelia afzelii
GAQQPTPATAPTQG

SEQ ID NO: 215179 - protein, 14 aa, Borrelia afzelii
AQQPTPATAPTQGG

SEQ ID NO: 215180 - protein, 14 aa, Borrelia afzelii
QQPTPATAPTQGGV

SEQ ID NO: 215181 - protein, 14 aa, Borrelia afzelii
QPTPATAPTQGGVN

SEQ ID NO: 215182 - protein, 14 aa, Borrelia afzelii
PTPATAPTQGGVNS

SEQ ID NO: 215183 - protein, 14 aa, Borrelia afzelii
TPATAPTQGGVNSP

SEQ ID NO: 215184 - protein, 14 aa, Borrelia afzelii
PATAPTQGGVNSPV

SEQ ID NO: 215185 - protein, 14 aa, Borrelia afzelii
ATAPTQGGVNSPVN

SEQ ID NO: 215186 - protein, 14 aa, Borrelia afzelii
TAPTQGGVNSPVNV

SEQ ID NO: 215187 - protein, 14 aa, Borrelia afzelii
APTQGGVNSPVNVT

SEQ ID NO: 215188 - protein, 14 aa, Borrelia afzelii
PTQGGVNSPVNVTT

SEQ ID NO: 215189 - protein, 14 aa, Borrelia afzelii
TQGGVNSPVNVTTT

SEQ ID NO: 215190 - protein, 14 aa, Borrelia afzelii
QGGVNSPVNVTTTV

SEQ ID NO: 215191 - protein, 14 aa, Borrelia afzelii
GGVNSPVNVTTTVD

SEQ ID NO: 215192 - protein, 14 aa, Borrelia afzelii
GVNSPVNVTTTVDA

SEQ ID NO: 215193 - protein, 14 aa, Borrelia afzelii
VNSPVNVTTTVDAN

SEQ ID NO: 215194 - protein, 14 aa, Borrelia afzelii
NSPVNVTTTVDANT

SEQ ID NO: 215195 - protein, 14 aa, Borrelia afzelii
SPVNVTTTVDANTS

SEQ ID NO: 215196 - protein, 14 aa, Borrelia afzelii
PVNVTTTVDANTSL

SEQ ID NO: 215197 - protein, 14 aa, Borrelia afzelii
VNVTTTVDANTSLA

SEQ ID NO: 215198 - protein, 14 aa, Borrelia afzelii
NVTTTVDANTSLAK

SEQ ID NO: 215199 - protein, 14 aa, Borrelia afzelii
VTTTVDANTSLAKI

SEQ ID NO: 215200 - protein, 14 aa, Borrelia afzelii
TTTVDANTSLAKIE

SEQ ID NO: 215201 - protein, 14 aa, Borrelia afzelii
TTVDANTSLAKIEN

SEQ ID NO: 215202 - protein, 14 aa, Borrelia afzelii
TVDANTSLAKIENA

SEQ ID NO: 215203 - protein, 14 aa, Borrelia afzelii
VDANTSLAKIENAI

SEQ ID NO: 215204 - protein, 14 aa, Borrelia afzelii
DANTSLAKIENAIR

SEQ ID NO: 215205 - protein, 14 aa, Borrelia afzelii
ANTSLAKIENAIRM

SEQ ID NO: 215206 - protein, 14 aa, Borrelia afzelii
NTSLAKIENAIRMI

SEQ ID NO: 215207 - protein, 14 aa, Borrelia afzelii
TSLAKIENAIRMIS

SEQ ID NO: 215208 - protein, 14 aa, Borrelia afzelii
SLAKIENAIRMISD

SEQ ID NO: 215209 - protein, 14 aa, Borrelia afzelii
LAKIENAIRMISDQ

SEQ ID NO: 215210 - protein, 14 aa, Borrelia afzelii
AKIENAIRMISDQR

SEQ ID NO: 215211 - protein, 14 aa, Borrelia afzelii
KIENAIRMISDQRA

SEQ ID NO: 215212 - protein, 14 aa, Borrelia afzelii
IENAIRMISDQRAN

SEQ ID NO: 215213 - protein, 14 aa, Borrelia afzelii
ENAIRMISDQRANL

SEQ ID NO: 215214 - protein, 14 aa, Borrelia afzelii
NAIRMISDQRANLG

SEQ ID NO: 215215 - protein, 14 aa, Borrelia afzelii
AIRMISDQRANLGA

SEQ ID NO: 215216 - protein, 14 aa, Borrelia afzelii
IRMISDQRANLGAF

SEQ ID NO: 215217 - protein, 14 aa, Borrelia afzelii
RMISDQRANLGAFQ

SEQ ID NO: 215218 - protein, 14 aa, Borrelia afzelii
MISDQRANLGAFQN

SEQ ID NO: 215219 - protein, 14 aa, Borrelia afzelii
ISDQRANLGAFQNR

SEQ ID NO: 215220 - protein, 14 aa, Borrelia afzelii
SDQRANLGAFQNRL

SEQ ID NO: 215221 - protein, 14 aa, Borrelia afzelii
DQRANLGAFQNRLE

SEQ ID NO: 215222 - protein, 14 aa, Borrelia afzelii
QRANLGAFQNRLES

SEQ ID NO: 215223 - protein, 14 aa, Borrelia afzelii
RANLGAFQNRLESI

SEQ ID NO: 215224 - protein, 14 aa, Borrelia afzelii
ANLGAFQNRLESIK

SEQ ID NO: 215225 - protein, 14 aa, Borrelia afzelii
NLGAFQNRLESIKN

SEQ ID NO: 215226 - protein, 14 aa, Borrelia afzelii
LGAFQNRLESIKNS

SEQ ID NO: 215227 - protein, 14 aa, Borrelia afzelii
GAFQNRLESIKNST

SEQ ID NO: 215228 - protein, 14 aa, Borrelia afzelii
AFQNRLESIKNSTE

SEQ ID NO: 215229 - protein, 14 aa, Borrelia afzelii
FQNRLESIKNSTEY

SEQ ID NO: 215230 - protein, 14 aa, Borrelia afzelii
QNRLESIKNSTEYA

SEQ ID NO: 215231 - protein, 14 aa, Borrelia afzelii
NRLESIKNSTEYAI

SEQ ID NO: 215232 - protein, 14 aa, Borrelia afzelii
RLESIKNSTEYAIE

SEQ ID NO: 215233 - protein, 14 aa, Borrelia afzelii
LESIKNSTEYAIEN

SEQ ID NO: 215234 - protein, 14 aa, Borrelia afzelii
ESIKNSTEYAIENL

SEQ ID NO: 215235 - protein, 14 aa, Borrelia afzelii
SIKNSTEYAIENLK

SEQ ID NO: 215236 - protein, 14 aa, Borrelia afzelii
IKNSTEYAIENLKA

SEQ ID NO: 215237 - protein, 14 aa, Borrelia afzelii
KNSTEYAIENLKAS

SEQ ID NO: 215238 - protein, 14 aa, Borrelia afzelii
NSTEYAIENLKASY

SEQ ID NO: 215239 - protein, 14 aa, Borrelia afzelii
STEYAIENLKASYA

SEQ ID NO: 215240 - protein, 14 aa, Borrelia afzelii
TEYAIENLKASYAQ

SEQ ID NO: 215241 - protein, 14 aa, Borrelia afzelii
EYAIENLKASYAQI

SEQ ID NO: 215242 - protein, 14 aa, Borrelia afzelii
YAIENLKASYAQIK

SEQ ID NO: 215243 - protein, 14 aa, Borrelia afzelii
AIENLKASYAQIKD

SEQ ID NO: 215244 - protein, 14 aa, Borrelia afzelii
IENLKASYAQIKDA

SEQ ID NO: 215245 - protein, 14 aa, Borrelia afzelii
ENLKASYAQIKDAT

SEQ ID NO: 215246 - protein, 14 aa, Borrelia afzelii
NLKASYAQIKDATM

SEQ ID NO: 215247 - protein, 14 aa, Borrelia afzelii
LKASYAQIKDATMT

SEQ ID NO: 215248 - protein, 14 aa, Borrelia afzelii
KASYAQIKDATMTD

SEQ ID NO: 215249 - protein, 14 aa, Borrelia afzelii
ASYAQIKDATMTDE

SEQ ID NO: 215250 - protein, 14 aa, Borrelia afzelii
SYAQIKDATMTDEV

SEQ ID NO: 215251 - protein, 14 aa, Borrelia afzelii
YAQIKDATMTDEVV

SEQ ID NO: 215252 - protein, 14 aa, Borrelia afzelii
AQIKDATMTDEVVA

SEQ ID NO: 215253 - protein, 14 aa, Borrelia afzelii
QIKDATMTDEVVAA

SEQ ID NO: 215254 - protein, 14 aa, Borrelia afzelii
IKDATMTDEVVAAT

SEQ ID NO: 215255 - protein, 14 aa, Borrelia afzelii
KDATMTDEVVAATT

SEQ ID NO: 215256 - protein, 14 aa, Borrelia afzelii
DATMTDEVVAATTN

SEQ ID NO: 215257 - protein, 14 aa, Borrelia afzelii
ATMTDEVVAATTNS

SEQ ID NO: 215258 - protein, 14 aa, Borrelia afzelii
TMTDEVVAATTNSI

SEQ ID NO: 215259 - protein, 14 aa, Borrelia afzelii
MTDEVVAATTNSIL

SEQ ID NO: 215260 - protein, 14 aa, Borrelia afzelii
TDEVVAATTNSILT

SEQ ID NO: 215261 - protein, 14 aa, Borrelia afzelii
DEVVAATTNSILTQ

SEQ ID NO: 215262 - protein, 14 aa, Borrelia afzelii
EVVAATTNSILTQS

SEQ ID NO: 215263 - protein, 14 aa, Borrelia afzelii
VVAATTNSILTQSA

SEQ ID NO: 215264 - protein, 14 aa, Borrelia afzelii
VAATTNSILTQSAM

SEQ ID NO: 215265 - protein, 14 aa, Borrelia afzelii
AATTNSILTQSAMA

SEQ ID NO: 215266 - protein, 14 aa, Borrelia afzelii
ATTNSILTQSAMAM

SEQ ID NO: 215267 - protein, 14 aa, Borrelia afzelii
TTNSILTQSAMAMI

SEQ ID NO: 215268 - protein, 14 aa, Borrelia afzelii
TNSILTQSAMAMIA

SEQ ID NO: 215269 - protein, 14 aa, Borrelia afzelii
NSILTQSAMAMIAQ

SEQ ID NO: 215270 - protein, 14 aa, Borrelia afzelii
SILTQSAMAMIAQA

SEQ ID NO: 215271 - protein, 14 aa, Borrelia afzelii
ILTQSAMAMIAQAN

SEQ ID NO: 215272 - protein, 14 aa, Borrelia afzelii
LTQSAMAMIAQANQ

SEQ ID NO: 215273 - protein, 14 aa, Borrelia afzelii
TQSAMAMIAQANQV

SEQ ID NO: 215274 - protein, 14 aa, Borrelia afzelii
QSAMAMIAQANQVP

SEQ ID NO: 215275 - protein, 14 aa, Borrelia afzelii
SAMAMIAQANQVPQ

SEQ ID NO: 215276 - protein, 14 aa, Borrelia afzelii
AMAMIAQANQVPQY

SEQ ID NO: 215277 - protein, 14 aa, Borrelia afzelii
MAMIAQANQVPQYV

SEQ ID NO: 215278 - protein, 14 aa, Borrelia afzelii
AMIAQANQVPQYVL

SEQ ID NO: 215279 - protein, 14 aa, Borrelia afzelii
MIAQANQVPQYVLS

SEQ ID NO: 215280 - protein, 14 aa, Borrelia afzelii
IAQANQVPQYVLSL

SEQ ID NO: 215281 - protein, 14 aa, Borrelia afzelii
AQANQVPQYVLSLL

SEQ ID NO: 215282 - protein, 14 aa, Borrelia afzelii
QANQVPQYVLSLLR

SEQ ID NO: 215283 - protein, 15 aa, Borrelia afzelii
MIINHNTSAINASRN

SEQ ID NO: 215284 - protein, 15 aa, Borrelia afzelii
IINHNTSAINASRNN

SEQ ID NO: 215285 - protein, 15 aa, Borrelia afzelii
INHNTSAINASRNNA

SEQ ID NO: 215286 - protein, 15 aa, Borrelia afzelii
NHNTSAINASRNNAI

SEQ ID NO: 215287 - protein, 15 aa, Borrelia afzelii
HNTSAINASRNNAIN

SEQ ID NO: 215288 - protein, 15 aa, Borrelia afzelii
NTSAINASRNNAINA

SEQ ID NO: 215289 - protein, 15 aa, Borrelia afzelii
TSAINASRNNAINAA

SEQ ID NO: 215290 - protein, 15 aa, Borrelia afzelii
SAINASRNNAINAAN

SEQ ID NO: 215291 - protein, 15 aa, Borrelia afzelii
AINASRNNAINAANL

SEQ ID NO: 215292 - protein, 15 aa, Borrelia afzelii
INASRNNAINAANLS

SEQ ID NO: 215293 - protein, 15 aa, Borrelia afzelii
NASRNNAINAANLSK

SEQ ID NO: 215294 - protein, 15 aa, Borrelia afzelii
ASRNNAINAANLSKT

SEQ ID NO: 215295 - protein, 15 aa, Borrelia afzelii
SRNNAINAANLSKTQ

SEQ ID NO: 215296 - protein, 15 aa, Borrelia afzelii
RNNAINAANLSKTQE

SEQ ID NO: 215297 - protein, 15 aa, Borrelia afzelii
NNAINAANLSKTQEK

SEQ ID NO: 215298 - protein, 15 aa, Borrelia afzelii
NAINAANLSKTQEKL

SEQ ID NO: 215299 - protein, 15 aa, Borrelia afzelii
AINAANLSKTQEKLS

SEQ ID NO: 215300 - protein, 15 aa, Borrelia afzelii
INAANLSKTQEKLSS

SEQ ID NO: 215301 - protein, 15 aa, Borrelia afzelii
NAANLSKTQEKLSSG

SEQ ID NO: 215302 - protein, 15 aa, Borrelia afzelii
AANLSKTQEKLSSGY

SEQ ID NO: 215303 - protein, 15 aa, Borrelia afzelii
ANLSKTQEKLSSGYR

SEQ ID NO: 215304 - protein, 15 aa, Borrelia afzelii
NLSKTQEKLSSGYRI

SEQ ID NO: 215305 - protein, 15 aa, Borrelia afzelii
LSKTQEKLSSGYRIN

SEQ ID NO: 215306 - protein, 15 aa, Borrelia afzelii
SKTQEKLSSGYRINR

SEQ ID NO: 215307 - protein, 15 aa, Borrelia afzelii
KTQEKLSSGYRINRA

SEQ ID NO: 215308 - protein, 15 aa, Borrelia afzelii
TQEKLSSGYRINRAS

SEQ ID NO: 215309 - protein, 15 aa, Borrelia afzelii
QEKLSSGYRINRASD

SEQ ID NO: 215310 - protein, 15 aa, Borrelia afzelii
EKLSSGYRINRASDD

SEQ ID NO: 215311 - protein, 15 aa, Borrelia afzelii
KLSSGYRINRASDDA

SEQ ID NO: 215312 - protein, 15 aa, Borrelia afzelii
LSSGYRINRASDDAA

SEQ ID NO: 215313 - protein, 15 aa, Borrelia afzelii
SSGYRINRASDDAAG

SEQ ID NO: 215314 - protein, 15 aa, Borrelia afzelii
SGYRINRASDDAAGM

SEQ ID NO: 215315 - protein, 15 aa, Borrelia afzelii
GYRINRASDDAAGMG

SEQ ID NO: 215316 - protein, 15 aa, Borrelia afzelii
YRINRASDDAAGMGV

SEQ ID NO: 215317 - protein, 15 aa, Borrelia afzelii
RINRASDDAAGMGVS

SEQ ID NO: 215318 - protein, 15 aa, Borrelia afzelii
INRASDDAAGMGVSG

SEQ ID NO: 215319 - protein, 15 aa, Borrelia afzelii
NRASDDAAGMGVSGK

SEQ ID NO: 215320 - protein, 15 aa, Borrelia afzelii
RASDDAAGMGVSGKI

SEQ ID NO: 215321 - protein, 15 aa, Borrelia afzelii
ASDDAAGMGVSGKIN

SEQ ID NO: 215322 - protein, 15 aa, Borrelia afzelii
SDDAAGMGVSGKINA

SEQ ID NO: 215323 - protein, 15 aa, Borrelia afzelii
DDAAGMGVSGKINAQ

SEQ ID NO: 215324 - protein, 15 aa, Borrelia afzelii
DAAGMGVSGKINAQI

SEQ ID NO: 215325 - protein, 15 aa, Borrelia afzelii
AAGMGVSGKINAQIR

SEQ ID NO: 215326 - protein, 15 aa, Borrelia afzelii
AGMGVSGKINAQIRG

SEQ ID NO: 215327 - protein, 15 aa, Borrelia afzelii
GMGVSGKINAQIRGL

SEQ ID NO: 215328 - protein, 15 aa, Borrelia afzelii
MGVSGKINAQIRGLS

SEQ ID NO: 215329 - protein, 15 aa, Borrelia afzelii
GVSGKINAQIRGLSQ

SEQ ID NO: 215330 - protein, 15 aa, Borrelia afzelii
VSGKINAQIRGLSQA

SEQ ID NO: 215331 - protein, 15 aa, Borrelia afzelii
SGKINAQIRGLSQAS

SEQ ID NO: 215332 - protein, 15 aa, Borrelia afzelii
GKINAQIRGLSQASR

SEQ ID NO: 215333 - protein, 15 aa, Borrelia afzelii
KINAQIRGLSQASRN

SEQ ID NO: 215334 - protein, 15 aa, Borrelia afzelii
INAQIRGLSQASRNT

SEQ ID NO: 215335 - protein, 15 aa, Borrelia afzelii
NAQIRGLSQASRNTS

SEQ ID NO: 215336 - protein, 15 aa, Borrelia afzelii
AQIRGLSQASRNTSK

SEQ ID NO: 215337 - protein, 15 aa, Borrelia afzelii
QIRGLSQASRNTSKA

SEQ ID NO: 215338 - protein, 15 aa, Borrelia afzelii
IRGLSQASRNTSKAI

SEQ ID NO: 215339 - protein, 15 aa, Borrelia afzelii
RGLSQASRNTSKAIN

SEQ ID NO: 215340 - protein, 15 aa, Borrelia afzelii
GLSQASRNTSKAINF

SEQ ID NO: 215341 - protein, 15 aa, Borrelia afzelii
LSQASRNTSKAINFI

SEQ ID NO: 215342 - protein, 15 aa, Borrelia afzelii
SQASRNTSKAINFIQ

SEQ ID NO: 215343 - protein, 15 aa, Borrelia afzelii
QASRNTSKAINFIQT

SEQ ID NO: 215344 - protein, 15 aa, Borrelia afzelii
ASRNTSKAINFIQTT

SEQ ID NO: 215345 - protein, 15 aa, Borrelia afzelii
SRNTSKAINFIQTTE

SEQ ID NO: 215346 - protein, 15 aa, Borrelia afzelii
RNTSKAINFIQTTEG

SEQ ID NO: 215347 - protein, 15 aa, Borrelia afzelii
NTSKAINFIQTTEGN

SEQ ID NO: 215348 - protein, 15 aa, Borrelia afzelii
TSKAINFIQTTEGNL

SEQ ID NO: 215349 - protein, 15 aa, Borrelia afzelii
SKAINFIQTTEGNLN

SEQ ID NO: 215350 - protein, 15 aa, Borrelia afzelii
KAINFIQTTEGNLNE

SEQ ID NO: 215351 - protein, 15 aa, Borrelia afzelii
AINFIQTTEGNLNEV

SEQ ID NO: 215352 - protein, 15 aa, Borrelia afzelii
INFIQTTEGNLNEVE

SEQ ID NO: 215353 - protein, 15 aa, Borrelia afzelii
NFIQTTEGNLNEVEK

SEQ ID NO: 215354 - protein, 15 aa, Borrelia afzelii
FIQTTEGNLNEVEKV

SEQ ID NO: 215355 - protein, 15 aa, Borrelia afzelii
IQTTEGNLNEVEKVL

SEQ ID NO: 215356 - protein, 15 aa, Borrelia afzelii
QTTEGNLNEVEKVLV

SEQ ID NO: 215357 - protein, 15 aa, Borrelia afzelii
TTEGNLNEVEKVLVR

SEQ ID NO: 215358 - protein, 15 aa, Borrelia afzelii
TEGNLNEVEKVLVRM

SEQ ID NO: 215359 - protein, 15 aa, Borrelia afzelii
EGNLNEVEKVLVRMK

SEQ ID NO: 215360 - protein, 15 aa, Borrelia afzelii
GNLNEVEKVLVRMKE

SEQ ID NO: 215361 - protein, 15 aa, Borrelia afzelii
NLNEVEKVLVRMKEL

SEQ ID NO: 215362 - protein, 15 aa, Borrelia afzelii
LNEVEKVLVRMKELA

SEQ ID NO: 215363 - protein, 15 aa, Borrelia afzelii
NEVEKVLVRMKELAV

SEQ ID NO: 215364 - protein, 15 aa, Borrelia afzelii
EVEKVLVRMKELAVQ

SEQ ID NO: 215365 - protein, 15 aa, Borrelia afzelii
VEKVLVRMKELAVQS

SEQ ID NO: 215366 - protein, 15 aa, Borrelia afzelii
EKVLVRMKELAVQSG

SEQ ID NO: 215367 - protein, 15 aa, Borrelia afzelii
KVLVRMKELAVQSGN

SEQ ID NO: 215368 - protein, 15 aa, Borrelia afzelii
VLVRMKELAVQSGNG

SEQ ID NO: 215369 - protein, 15 aa, Borrelia afzelii
LVRMKELAVQSGNGT

SEQ ID NO: 215370 - protein, 15 aa, Borrelia afzelii
VRMKELAVQSGNGTY

SEQ ID NO: 215371 - protein, 15 aa, Borrelia afzelii
RMKELAVQSGNGTYS

SEQ ID NO: 215372 - protein, 15 aa, Borrelia afzelii
MKELAVQSGNGTYSD

SEQ ID NO: 215373 - protein, 15 aa, Borrelia afzelii
KELAVQSGNGTYSDS

SEQ ID NO: 215374 - protein, 15 aa, Borrelia afzelii
ELAVQSGNGTYSDSD

SEQ ID NO: 215375 - protein, 15 aa, Borrelia afzelii
LAVQSGNGTYSDSDR

SEQ ID NO: 215376 - protein, 15 aa, Borrelia afzelii
AVQSGNGTYSDSDRG

SEQ ID NO: 215377 - protein, 15 aa, Borrelia afzelii
VQSGNGTYSDSDRGS

SEQ ID NO: 215378 - protein, 15 aa, Borrelia afzelii
QSGNGTYSDSDRGSI

SEQ ID NO: 215379 - protein, 15 aa, Borrelia afzelii
SGNGTYSDSDRGSIQ

SEQ ID NO: 215380 - protein, 15 aa, Borrelia afzelii
GNGTYSDSDRGSIQI

SEQ ID NO: 215381 - protein, 15 aa, Borrelia afzelii
NGTYSDSDRGSIQIE

SEQ ID NO: 215382 - protein, 15 aa, Borrelia afzelii
GTYSDSDRGSIQIEI

SEQ ID NO: 215383 - protein, 15 aa, Borrelia afzelii
TYSDSDRGSIQIEIE

SEQ ID NO: 215384 - protein, 15 aa, Borrelia afzelii
YSDSDRGSIQIEIEQ

SEQ ID NO: 215385 - protein, 15 aa, Borrelia afzelii
SDSDRGSIQIEIEQL

SEQ ID NO: 215386 - protein, 15 aa, Borrelia afzelii
DSDRGSIQIEIEQLT

SEQ ID NO: 215387 - protein, 15 aa, Borrelia afzelii
SDRGSIQIEIEQLTD

SEQ ID NO: 215388 - protein, 15 aa, Borrelia afzelii
DRGSIQIEIEQLTDE

SEQ ID NO: 215389 - protein, 15 aa, Borrelia afzelii
RGSIQIEIEQLTDEI

SEQ ID NO: 215390 - protein, 15 aa, Borrelia afzelii
GSIQIEIEQLTDEIN

SEQ ID NO: 215391 - protein, 15 aa, Borrelia afzelii
SIQIEIEQLTDEINR

SEQ ID NO: 215392 - protein, 15 aa, Borrelia afzelii
IQIEIEQLTDEINRI

SEQ ID NO: 215393 - protein, 15 aa, Borrelia afzelii
QIEIEQLTDEINRIA

SEQ ID NO: 215394 - protein, 15 aa, Borrelia afzelii
IEIEQLTDEINRIAD

SEQ ID NO: 215395 - protein, 15 aa, Borrelia afzelii
EIEQLTDEINRIADQ

SEQ ID NO: 215396 - protein, 15 aa, Borrelia afzelii
IEQLTDEINRIADQA

SEQ ID NO: 215397 - protein, 15 aa, Borrelia afzelii
EQLTDEINRIADQAQ

SEQ ID NO: 215398 - protein, 15 aa, Borrelia afzelii
QLTDEINRIADQAQY

SEQ ID NO: 215399 - protein, 15 aa, Borrelia afzelii
LTDEINRIADQAQYN

SEQ ID NO: 215400 - protein, 15 aa, Borrelia afzelii
TDEINRIADQAQYNQ

SEQ ID NO: 215401 - protein, 15 aa, Borrelia afzelii
DEINRIADQAQYNQM

SEQ ID NO: 215402 - protein, 15 aa, Borrelia afzelii
EINRIADQAQYNQMH

SEQ ID NO: 215403 - protein, 15 aa, Borrelia afzelii
INRIADQAQYNQMHM

SEQ ID NO: 215404 - protein, 15 aa, Borrelia afzelii
NRIADQAQYNQMHML

SEQ ID NO: 215405 - protein, 15 aa, Borrelia afzelii
RIADQAQYNQMHMLS

SEQ ID NO: 215406 - protein, 15 aa, Borrelia afzelii
IADQAQYNQMHMLSN

SEQ ID NO: 215407 - protein, 15 aa, Borrelia afzelii
ADQAQYNQMHMLSNK

SEQ ID NO: 215408 - protein, 15 aa, Borrelia afzelii
DQAQYNQMHMLSNKS

SEQ ID NO: 215409 - protein, 15 aa, Borrelia afzelii
QAQYNQMHMLSNKSA

SEQ ID NO: 215410 - protein, 15 aa, Borrelia afzelii
AQYNQMHMLSNKSAS

SEQ ID NO: 215411 - protein, 15 aa, Borrelia afzelii
QYNQMHMLSNKSASQ

SEQ ID NO: 215412 - protein, 15 aa, Borrelia afzelii
YNQMHMLSNKSASQN

SEQ ID NO: 215413 - protein, 15 aa, Borrelia afzelii
NQMHMLSNKSASQNV

SEQ ID NO: 215414 - protein, 15 aa, Borrelia afzelii
QMHMLSNKSASQNVK

SEQ ID NO: 215415 - protein, 15 aa, Borrelia afzelii
MHMLSNKSASQNVKT

SEQ ID NO: 215416 - protein, 15 aa, Borrelia afzelii
HMLSNKSASQNVKTA

SEQ ID NO: 215417 - protein, 15 aa, Borrelia afzelii
MLSNKSASQNVKTAE

SEQ ID NO: 215418 - protein, 15 aa, Borrelia afzelii
LSNKSASQNVKTAEE

SEQ ID NO: 215419 - protein, 15 aa, Borrelia afzelii
SNKSASQNVKTAEEL

SEQ ID NO: 215420 - protein, 15 aa, Borrelia afzelii
NKSASQNVKTAEELG

SEQ ID NO: 215421 - protein, 15 aa, Borrelia afzelii
KSASQNVKTAEELGM

SEQ ID NO: 215422 - protein, 15 aa, Borrelia afzelii
SASQNVKTAEELGMQ

SEQ ID NO: 215423 - protein, 15 aa, Borrelia afzelii
ASQNVKTAEELGMQP

SEQ ID NO: 215424 - protein, 15 aa, Borrelia afzelii
SQNVKTAEELGMQPA

SEQ ID NO: 215425 - protein, 15 aa, Borrelia afzelii
QNVKTAEELGMQPAK

SEQ ID NO: 215426 - protein, 15 aa, Borrelia afzelii
NVKTAEELGMQPAKI

SEQ ID NO: 215427 - protein, 15 aa, Borrelia afzelii
VKTAEELGMQPAKIN

SEQ ID NO: 215428 - protein, 15 aa, Borrelia afzelii
KTAEELGMQPAKINT

SEQ ID NO: 215429 - protein, 15 aa, Borrelia afzelii
TAEELGMQPAKINTP

SEQ ID NO: 215430 - protein, 15 aa, Borrelia afzelii
AEELGMQPAKINTPA

SEQ ID NO: 215431 - protein, 15 aa, Borrelia afzelii
EELGMQPAKINTPAS

SEQ ID NO: 215432 - protein, 15 aa, Borrelia afzelii
ELGMQPAKINTPASL

SEQ ID NO: 215433 - protein, 15 aa, Borrelia afzelii
LGMQPAKINTPASLS

SEQ ID NO: 215434 - protein, 15 aa, Borrelia afzelii
GMQPAKINTPASLSG

SEQ ID NO: 215435 - protein, 15 aa, Borrelia afzelii
MQPAKINTPASLSGS

SEQ ID NO: 215436 - protein, 15 aa, Borrelia afzelii
QPAKINTPASLSGSQ

SEQ ID NO: 215437 - protein, 15 aa, Borrelia afzelii
PAKINTPASLSGSQA

SEQ ID NO: 215438 - protein, 15 aa, Borrelia afzelii
AKINTPASLSGSQAS

SEQ ID NO: 215439 - protein, 15 aa, Borrelia afzelii
KINTPASLSGSQASW

SEQ ID NO: 215440 - protein, 15 aa, Borrelia afzelii
INTPASLSGSQASWT

SEQ ID NO: 215441 - protein, 15 aa, Borrelia afzelii
NTPASLSGSQASWTL

SEQ ID NO: 215442 - protein, 15 aa, Borrelia afzelii
TPASLSGSQASWTLR

SEQ ID NO: 215443 - protein, 15 aa, Borrelia afzelii
PASLSGSQASWTLRV

SEQ ID NO: 215444 - protein, 15 aa, Borrelia afzelii
ASLSGSQASWTLRVH

SEQ ID NO: 215445 - protein, 15 aa, Borrelia afzelii
SLSGSQASWTLRVHV

SEQ ID NO: 215446 - protein, 15 aa, Borrelia afzelii
LSGSQASWTLRVHVG

SEQ ID NO: 215447 - protein, 15 aa, Borrelia afzelii
SGSQASWTLRVHVGA

SEQ ID NO: 215448 - protein, 15 aa, Borrelia afzelii
GSQASWTLRVHVGAN

SEQ ID NO: 215449 - protein, 15 aa, Borrelia afzelii
SQASWTLRVHVGANQ

SEQ ID NO: 215450 - protein, 15 aa, Borrelia afzelii
QASWTLRVHVGANQD

SEQ ID NO: 215451 - protein, 15 aa, Borrelia afzelii
ASWTLRVHVGANQDE

SEQ ID NO: 215452 - protein, 15 aa, Borrelia afzelii
SWTLRVHVGANQDEA

SEQ ID NO: 215453 - protein, 15 aa, Borrelia afzelii
WTLRVHVGANQDEAI

SEQ ID NO: 215454 - protein, 15 aa, Borrelia afzelii
TLRVHVGANQDEAIA

SEQ ID NO: 215455 - protein, 15 aa, Borrelia afzelii
LRVHVGANQDEAIAV

SEQ ID NO: 215456 - protein, 15 aa, Borrelia afzelii
RVHVGANQDEAIAVN

SEQ ID NO: 215457 - protein, 15 aa, Borrelia afzelii
VHVGANQDEAIAVNI

SEQ ID NO: 215458 - protein, 15 aa, Borrelia afzelii
HVGANQDEAIAVNIY

SEQ ID NO: 215459 - protein, 15 aa, Borrelia afzelii
VGANQDEAIAVNIYS

SEQ ID NO: 215460 - protein, 15 aa, Borrelia afzelii
GANQDEAIAVNIYSA

SEQ ID NO: 215461 - protein, 15 aa, Borrelia afzelii
ANQDEAIAVNIYSAN

SEQ ID NO: 215462 - protein, 15 aa, Borrelia afzelii
NQDEAIAVNIYSANV

SEQ ID NO: 215463 - protein, 15 aa, Borrelia afzelii
QDEAIAVNIYSANVA

SEQ ID NO: 215464 - protein, 15 aa, Borrelia afzelii
DEAIAVNIYSANVAN

SEQ ID NO: 215465 - protein, 15 aa, Borrelia afzelii
EAIAVNIYSANVANL

SEQ ID NO: 215466 - protein, 15 aa, Borrelia afzelii
AIAVNIYSANVANLF

SEQ ID NO: 215467 - protein, 15 aa, Borrelia afzelii
IAVNIYSANVANLFA

SEQ ID NO: 215468 - protein, 15 aa, Borrelia afzelii
AVNIYSANVANLFAG

SEQ ID NO: 215469 - protein, 15 aa, Borrelia afzelii
VNIYSANVANLFAGE

SEQ ID NO: 215470 - protein, 15 aa, Borrelia afzelii
NIYSANVANLFAGEG

SEQ ID NO: 215471 - protein, 15 aa, Borrelia afzelii
IYSANVANLFAGEGA

SEQ ID NO: 215472 - protein, 15 aa, Borrelia afzelii
YSANVANLFAGEGAQ

SEQ ID NO: 215473 - protein, 15 aa, Borrelia afzelii
SANVANLFAGEGAQA

SEQ ID NO: 215474 - protein, 15 aa, Borrelia afzelii
ANVANLFAGEGAQAA

SEQ ID NO: 215475 - protein, 15 aa, Borrelia afzelii
NVANLFAGEGAQAAQ

SEQ ID NO: 215476 - protein, 15 aa, Borrelia afzelii
VANLFAGEGAQAAQA

SEQ ID NO: 215477 - protein, 15 aa, Borrelia afzelii
ANLFAGEGAQAAQAA

SEQ ID NO: 215478 - protein, 15 aa, Borrelia afzelii
NLFAGEGAQAAQAAP

SEQ ID NO: 215479 - protein, 15 aa, Borrelia afzelii
LFAGEGAQAAQAAPV

SEQ ID NO: 215480 - protein, 15 aa, Borrelia afzelii
FAGEGAQAAQAAPVQ

SEQ ID NO: 215481 - protein, 15 aa, Borrelia afzelii
AGEGAQAAQAAPVQE

SEQ ID NO: 215482 - protein, 15 aa, Borrelia afzelii
GEGAQAAQAAPVQEG

SEQ ID NO: 215483 - protein, 15 aa, Borrelia afzelii
EGAQAAQAAPVQEGA

SEQ ID NO: 215484 - protein, 15 aa, Borrelia afzelii
GAQAAQAAPVQEGAQ

SEQ ID NO: 215485 - protein, 15 aa, Borrelia afzelii
AQAAQAAPVQEGAQE

SEQ ID NO: 215486 - protein, 15 aa, Borrelia afzelii
QAAQAAPVQEGAQEE

SEQ ID NO: 215487 - protein, 15 aa, Borrelia afzelii
AAQAAPVQEGAQEEG

SEQ ID NO: 215488 - protein, 15 aa, Borrelia afzelii
AQAAPVQEGAQEEGA

SEQ ID NO: 215489 - protein, 15 aa, Borrelia afzelii
QAAPVQEGAQEEGAQ

SEQ ID NO: 215490 - protein, 15 aa, Borrelia afzelii
AAPVQEGAQEEGAQQ

SEQ ID NO: 215491 - protein, 15 aa, Borrelia afzelii
APVQEGAQEEGAQQP

SEQ ID NO: 215492 - protein, 15 aa, Borrelia afzelii
PVQEGAQEEGAQQPT

SEQ ID NO: 215493 - protein, 15 aa, Borrelia afzelii
VQEGAQEEGAQQPTP

SEQ ID NO: 215494 - protein, 15 aa, Borrelia afzelii
QEGAQEEGAQQPTPA

SEQ ID NO: 215495 - protein, 15 aa, Borrelia afzelii
EGAQEEGAQQPTPAT

SEQ ID NO: 215496 - protein, 15 aa, Borrelia afzelii
GAQEEGAQQPTPATA

SEQ ID NO: 215497 - protein, 15 aa, Borrelia afzelii
AQEEGAQQPTPATAP

SEQ ID NO: 215498 - protein, 15 aa, Borrelia afzelii
QEEGAQQPTPATAPT

SEQ ID NO: 215499 - protein, 15 aa, Borrelia afzelii
EEGAQQPTPATAPTQ

SEQ ID NO: 215500 - protein, 15 aa, Borrelia afzelii
EGAQQPTPATAPTQG

SEQ ID NO: 215501 - protein, 15 aa, Borrelia afzelii
GAQQPTPATAPTQGG

SEQ ID NO: 215502 - protein, 15 aa, Borrelia afzelii
AQQPTPATAPTQGGV

SEQ ID NO: 215503 - protein, 15 aa, Borrelia afzelii
QQPTPATAPTQGGVN

SEQ ID NO: 215504 - protein, 15 aa, Borrelia afzelii
QPTPATAPTQGGVNS

SEQ ID NO: 215505 - protein, 15 aa, Borrelia afzelii
PTPATAPTQGGVNSP

SEQ ID NO: 215506 - protein, 15 aa, Borrelia afzelii
TPATAPTQGGVNSPV

SEQ ID NO: 215507 - protein, 15 aa, Borrelia afzelii
PATAPTQGGVNSPVN

SEQ ID NO: 215508 - protein, 15 aa, Borrelia afzelii
ATAPTQGGVNSPVNV

SEQ ID NO: 215509 - protein, 15 aa, Borrelia afzelii
TAPTQGGVNSPVNVT

SEQ ID NO: 215510 - protein, 15 aa, Borrelia afzelii
APTQGGVNSPVNVTT

SEQ ID NO: 215511 - protein, 15 aa, Borrelia afzelii
PTQGGVNSPVNVTTT

SEQ ID NO: 215512 - protein, 15 aa, Borrelia afzelii
TQGGVNSPVNVTTTV

SEQ ID NO: 215513 - protein, 15 aa, Borrelia afzelii
QGGVNSPVNVTTTVD

SEQ ID NO: 215514 - protein, 15 aa, Borrelia afzelii
GGVNSPVNVTTTVDA

SEQ ID NO: 215515 - protein, 15 aa, Borrelia afzelii
GVNSPVNVTTTVDAN

SEQ ID NO: 215516 - protein, 15 aa, Borrelia afzelii
VNSPVNVTTTVDANT

SEQ ID NO: 215517 - protein, 15 aa, Borrelia afzelii
NSPVNVTTTVDANTS

SEQ ID NO: 215518 - protein, 15 aa, Borrelia afzelii
SPVNVTTTVDANTSL

SEQ ID NO: 215519 - protein, 15 aa, Borrelia afzelii
PVNVTTTVDANTSLA

SEQ ID NO: 215520 - protein, 15 aa, Borrelia afzelii
VNVTTTVDANTSLAK

SEQ ID NO: 215521 - protein, 15 aa, Borrelia afzelii
NVTTTVDANTSLAKI

SEQ ID NO: 215522 - protein, 15 aa, Borrelia afzelii
VTTTVDANTSLAKIE

SEQ ID NO: 215523 - protein, 15 aa, Borrelia afzelii
TTTVDANTSLAKIEN

SEQ ID NO: 215524 - protein, 15 aa, Borrelia afzelii
TTVDANTSLAKIENA

SEQ ID NO: 215525 - protein, 15 aa, Borrelia afzelii
TVDANTSLAKIENAI

SEQ ID NO: 215526 - protein, 15 aa, Borrelia afzelii
VDANTSLAKIENAIR

SEQ ID NO: 215527 - protein, 15 aa, Borrelia afzelii
DANTSLAKIENAIRM

SEQ ID NO: 215528 - protein, 15 aa, Borrelia afzelii
ANTSLAKIENAIRMI

SEQ ID NO: 215529 - protein, 15 aa, Borrelia afzelii
NTSLAKIENAIRMIS

SEQ ID NO: 215530 - protein, 15 aa, Borrelia afzelii
TSLAKIENAIRMISD

SEQ ID NO: 215531 - protein, 15 aa, Borrelia afzelii
SLAKIENAIRMISDQ

SEQ ID NO: 215532 - protein, 15 aa, Borrelia afzelii
LAKIENAIRMISDQR

SEQ ID NO: 215533 - protein, 15 aa, Borrelia afzelii
AKIENAIRMISDQRA

SEQ ID NO: 215534 - protein, 15 aa, Borrelia afzelii
KIENAIRMISDQRAN

SEQ ID NO: 215535 - protein, 15 aa, Borrelia afzelii
IENAIRMISDQRANL

SEQ ID NO: 215536 - protein, 15 aa, Borrelia afzelii
ENAIRMISDQRANLG

SEQ ID NO: 215537 - protein, 15 aa, Borrelia afzelii
NAIRMISDQRANLGA

SEQ ID NO: 215538 - protein, 15 aa, Borrelia afzelii
AIRMISDQRANLGAF

SEQ ID NO: 215539 - protein, 15 aa, Borrelia afzelii
IRMISDQRANLGAFQ

SEQ ID NO: 215540 - protein, 15 aa, Borrelia afzelii
RMISDQRANLGAFQN

SEQ ID NO: 215541 - protein, 15 aa, Borrelia afzelii
MISDQRANLGAFQNR

SEQ ID NO: 215542 - protein, 15 aa, Borrelia afzelii
ISDQRANLGAFQNRL

SEQ ID NO: 215543 - protein, 15 aa, Borrelia afzelii
SDQRANLGAFQNRLE

SEQ ID NO: 215544 - protein, 15 aa, Borrelia afzelii
DQRANLGAFQNRLES

SEQ ID NO: 215545 - protein, 15 aa, Borrelia afzelii
QRANLGAFQNRLESI

SEQ ID NO: 215546 - protein, 15 aa, Borrelia afzelii
RANLGAFQNRLESIK

SEQ ID NO: 215547 - protein, 15 aa, Borrelia afzelii
ANLGAFQNRLESIKN

SEQ ID NO: 215548 - protein, 15 aa, Borrelia afzelii
NLGAFQNRLESIKNS

SEQ ID NO: 215549 - protein, 15 aa, Borrelia afzelii
LGAFQNRLESIKNST

SEQ ID NO: 215550 - protein, 15 aa, Borrelia afzelii
GAFQNRLESIKNSTE

SEQ ID NO: 215551 - protein, 15 aa, Borrelia afzelii
AFQNRLESIKNSTEY

SEQ ID NO: 215552 - protein, 15 aa, Borrelia afzelii
FQNRLESIKNSTEYA

SEQ ID NO: 215553 - protein, 15 aa, Borrelia afzelii
QNRLESIKNSTEYAI

SEQ ID NO: 215554 - protein, 15 aa, Borrelia afzelii
NRLESIKNSTEYAIE

SEQ ID NO: 215555 - protein, 15 aa, Borrelia afzelii
RLESIKNSTEYAIEN

SEQ ID NO: 215556 - protein, 15 aa, Borrelia afzelii
LESIKNSTEYAIENL

SEQ ID NO: 215557 - protein, 15 aa, Borrelia afzelii
ESIKNSTEYAIENLK

SEQ ID NO: 215558 - protein, 15 aa, Borrelia afzelii
SIKNSTEYAIENLKA

SEQ ID NO: 215559 - protein, 15 aa, Borrelia afzelii
IKNSTEYAIENLKAS

SEQ ID NO: 215560 - protein, 15 aa, Borrelia afzelii
KNSTEYAIENLKASY

SEQ ID NO: 215561 - protein, 15 aa, Borrelia afzelii
NSTEYAIENLKASYA

SEQ ID NO: 215562 - protein, 15 aa, Borrelia afzelii
STEYAIENLKASYAQ

SEQ ID NO: 215563 - protein, 15 aa, Borrelia afzelii
TEYAIENLKASYAQI

SEQ ID NO: 215564 - protein, 15 aa, Borrelia afzelii
EYAIENLKASYAQIK

SEQ ID NO: 215565 - protein, 15 aa, Borrelia afzelii
YAIENLKASYAQIKD

SEQ ID NO: 215566 - protein, 15 aa, Borrelia afzelii
AIENLKASYAQIKDA

SEQ ID NO: 215567 - protein, 15 aa, Borrelia afzelii
IENLKASYAQIKDAT

SEQ ID NO: 215568 - protein, 15 aa, Borrelia afzelii
ENLKASYAQIKDATM

SEQ ID NO: 215569 - protein, 15 aa, Borrelia afzelii
NLKASYAQIKDATMT

SEQ ID NO: 215570 - protein, 15 aa, Borrelia afzelii
LKASYAQIKDATMTD

SEQ ID NO: 215571 - protein, 15 aa, Borrelia afzelii
KASYAQIKDATMTDE

SEQ ID NO: 215572 - protein, 15 aa, Borrelia afzelii
ASYAQIKDATMTDEV

SEQ ID NO: 215573 - protein, 15 aa, Borrelia afzelii
SYAQIKDATMTDEVV

SEQ ID NO: 215574 - protein, 15 aa, Borrelia afzelii
YAQIKDATMTDEVVA

SEQ ID NO: 215575 - protein, 15 aa, Borrelia afzelii
AQIKDATMTDEVVAA

SEQ ID NO: 215576 - protein, 15 aa, Borrelia afzelii
QIKDATMTDEVVAAT

SEQ ID NO: 215577 - protein, 15 aa, Borrelia afzelii
IKDATMTDEVVAATT

SEQ ID NO: 215578 - protein, 15 aa, Borrelia afzelii
KDATMTDEVVAATTN

SEQ ID NO: 215579 - protein, 15 aa, Borrelia afzelii
DATMTDEVVAATTNS

SEQ ID NO: 215580 - protein, 15 aa, Borrelia afzelii
ATMTDEVVAATTNSI

SEQ ID NO: 215581 - protein, 15 aa, Borrelia afzelii
TMTDEVVAATTNSIL

SEQ ID NO: 215582 - protein, 15 aa, Borrelia afzelii
MTDEVVAATTNSILT

SEQ ID NO: 215583 - protein, 15 aa, Borrelia afzelii
TDEVVAATTNSILTQ

SEQ ID NO: 215584 - protein, 15 aa, Borrelia afzelii
DEVVAATTNSILTQS

SEQ ID NO: 215585 - protein, 15 aa, Borrelia afzelii
EVVAATTNSILTQSA

SEQ ID NO: 215586 - protein, 15 aa, Borrelia afzelii
VVAATTNSILTQSAM

SEQ ID NO: 215587 - protein, 15 aa, Borrelia afzelii
VAATTNSILTQSAMA

SEQ ID NO: 215588 - protein, 15 aa, Borrelia afzelii
AATTNSILTQSAMAM

SEQ ID NO: 215589 - protein, 15 aa, Borrelia afzelii
ATTNSILTQSAMAMI

SEQ ID NO: 215590 - protein, 15 aa, Borrelia afzelii
TTNSILTQSAMAMIA

SEQ ID NO: 215591 - protein, 15 aa, Borrelia afzelii
TNSILTQSAMAMIAQ

SEQ ID NO: 215592 - protein, 15 aa, Borrelia afzelii
NSILTQSAMAMIAQA

SEQ ID NO: 215593 - protein, 15 aa, Borrelia afzelii
SILTQSAMAMIAQAN

SEQ ID NO: 215594 - protein, 15 aa, Borrelia afzelii
ILTQSAMAMIAQANQ

SEQ ID NO: 215595 - protein, 15 aa, Borrelia afzelii
LTQSAMAMIAQANQV

SEQ ID NO: 215596 - protein, 15 aa, Borrelia afzelii
TQSAMAMIAQANQVP

SEQ ID NO: 215597 - protein, 15 aa, Borrelia afzelii
QSAMAMIAQANQVPQ

SEQ ID NO: 215598 - protein, 15 aa, Borrelia afzelii
SAMAMIAQANQVPQY

SEQ ID NO: 215599 - protein, 15 aa, Borrelia afzelii
AMAMIAQANQVPQYV

SEQ ID NO: 215600 - protein, 15 aa, Borrelia afzelii
MAMIAQANQVPQYVL

SEQ ID NO: 215601 - protein, 15 aa, Borrelia afzelii
AMIAQANQVPQYVLS

SEQ ID NO: 215602 - protein, 15 aa, Borrelia afzelii
MIAQANQVPQYVLSL

SEQ ID NO: 215603 - protein, 15 aa, Borrelia afzelii
IAQANQVPQYVLSLL

SEQ ID NO: 215604 - protein, 15 aa, Borrelia afzelii
AQANQVPQYVLSLLR

SEQ ID NO: 215605 - protein, 16 aa, Borrelia afzelii
MIINHNTSAINASRNN

SEQ ID NO: 215606 - protein, 16 aa, Borrelia afzelii
IINHNTSAINASRNNA

SEQ ID NO: 215607 - protein, 16 aa, Borrelia afzelii
INHNTSAINASRNNAI

SEQ ID NO: 215608 - protein, 16 aa, Borrelia afzelii
NHNTSAINASRNNAIN

SEQ ID NO: 215609 - protein, 16 aa, Borrelia afzelii
HNTSAINASRNNAINA

SEQ ID NO: 215610 - protein, 16 aa, Borrelia afzelii
NTSAINASRNNAINAA

SEQ ID NO: 215611 - protein, 16 aa, Borrelia afzelii
TSAINASRNNAINAAN

SEQ ID NO: 215612 - protein, 16 aa, Borrelia afzelii
SAINASRNNAINAANL

SEQ ID NO: 215613 - protein, 16 aa, Borrelia afzelii
AINASRNNAINAANLS

SEQ ID NO: 215614 - protein, 16 aa, Borrelia afzelii
INASRNNAINAANLSK

SEQ ID NO: 215615 - protein, 16 aa, Borrelia afzelii
NASRNNAINAANLSKT

SEQ ID NO: 215616 - protein, 16 aa, Borrelia afzelii
ASRNNAINAANLSKTQ

SEQ ID NO: 215617 - protein, 16 aa, Borrelia afzelii
SRNNAINAANLSKTQE

SEQ ID NO: 215618 - protein, 16 aa, Borrelia afzelii
RNNAINAANLSKTQEK

SEQ ID NO: 215619 - protein, 16 aa, Borrelia afzelii
NNAINAANLSKTQEKL

SEQ ID NO: 215620 - protein, 16 aa, Borrelia afzelii
NAINAANLSKTQEKLS

SEQ ID NO: 215621 - protein, 16 aa, Borrelia afzelii
AINAANLSKTQEKLSS

SEQ ID NO: 215622 - protein, 16 aa, Borrelia afzelii
INAANLSKTQEKLSSG

SEQ ID NO: 215623 - protein, 16 aa, Borrelia afzelii
NAANLSKTQEKLSSGY

SEQ ID NO: 215624 - protein, 16 aa, Borrelia afzelii
AANLSKTQEKLSSGYR

SEQ ID NO: 215625 - protein, 16 aa, Borrelia afzelii
ANLSKTQEKLSSGYRI

SEQ ID NO: 215626 - protein, 16 aa, Borrelia afzelii
NLSKTQEKLSSGYRIN

SEQ ID NO: 215627 - protein, 16 aa, Borrelia afzelii
LSKTQEKLSSGYRINR

SEQ ID NO: 215628 - protein, 16 aa, Borrelia afzelii
SKTQEKLSSGYRINRA

SEQ ID NO: 215629 - protein, 16 aa, Borrelia afzelii
KTQEKLSSGYRINRAS

SEQ ID NO: 215630 - protein, 16 aa, Borrelia afzelii
TQEKLSSGYRINRASD

SEQ ID NO: 215631 - protein, 16 aa, Borrelia afzelii
QEKLSSGYRINRASDD

SEQ ID NO: 215632 - protein, 16 aa, Borrelia afzelii
EKLSSGYRINRASDDA

SEQ ID NO: 215633 - protein, 16 aa, Borrelia afzelii
KLSSGYRINRASDDAA

SEQ ID NO: 215634 - protein, 16 aa, Borrelia afzelii
LSSGYRINRASDDAAG

SEQ ID NO: 215635 - protein, 16 aa, Borrelia afzelii
SSGYRINRASDDAAGM

SEQ ID NO: 215636 - protein, 16 aa, Borrelia afzelii
SGYRINRASDDAAGMG

SEQ ID NO: 215637 - protein, 16 aa, Borrelia afzelii
GYRINRASDDAAGMGV

SEQ ID NO: 215638 - protein, 16 aa, Borrelia afzelii
YRINRASDDAAGMGVS

SEQ ID NO: 215639 - protein, 16 aa, Borrelia afzelii
RINRASDDAAGMGVSG

SEQ ID NO: 215640 - protein, 16 aa, Borrelia afzelii
INRASDDAAGMGVSGK

SEQ ID NO: 215641 - protein, 16 aa, Borrelia afzelii
NRASDDAAGMGVSGKI

SEQ ID NO: 215642 - protein, 16 aa, Borrelia afzelii
RASDDAAGMGVSGKIN

SEQ ID NO: 215643 - protein, 16 aa, Borrelia afzelii
ASDDAAGMGVSGKINA

SEQ ID NO: 215644 - protein, 16 aa, Borrelia afzelii
SDDAAGMGVSGKINAQ

SEQ ID NO: 215645 - protein, 16 aa, Borrelia afzelii
DDAAGMGVSGKINAQI

SEQ ID NO: 215646 - protein, 16 aa, Borrelia afzelii
DAAGMGVSGKINAQIR

SEQ ID NO: 215647 - protein, 16 aa, Borrelia afzelii
AAGMGVSGKINAQIRG

SEQ ID NO: 215648 - protein, 16 aa, Borrelia afzelii
AGMGVSGKINAQIRGL

SEQ ID NO: 215649 - protein, 16 aa, Borrelia afzelii
GMGVSGKINAQIRGLS

SEQ ID NO: 215650 - protein, 16 aa, Borrelia afzelii
MGVSGKINAQIRGLSQ

SEQ ID NO: 215651 - protein, 16 aa, Borrelia afzelii
GVSGKINAQIRGLSQA

SEQ ID NO: 215652 - protein, 16 aa, Borrelia afzelii
VSGKINAQIRGLSQAS

SEQ ID NO: 215653 - protein, 16 aa, Borrelia afzelii
SGKINAQIRGLSQASR

SEQ ID NO: 215654 - protein, 16 aa, Borrelia afzelii
GKINAQIRGLSQASRN

SEQ ID NO: 215655 - protein, 16 aa, Borrelia afzelii
KINAQIRGLSQASRNT

SEQ ID NO: 215656 - protein, 16 aa, Borrelia afzelii
INAQIRGLSQASRNTS

SEQ ID NO: 215657 - protein, 16 aa, Borrelia afzelii
NAQIRGLSQASRNTSK

SEQ ID NO: 215658 - protein, 16 aa, Borrelia afzelii
AQIRGLSQASRNTSKA

SEQ ID NO: 215659 - protein, 16 aa, Borrelia afzelii
QIRGLSQASRNTSKAI

SEQ ID NO: 215660 - protein, 16 aa, Borrelia afzelii
IRGLSQASRNTSKAIN

SEQ ID NO: 215661 - protein, 16 aa, Borrelia afzelii
RGLSQASRNTSKAINF

SEQ ID NO: 215662 - protein, 16 aa, Borrelia afzelii
GLSQASRNTSKAINFI

SEQ ID NO: 215663 - protein, 16 aa, Borrelia afzelii
LSQASRNTSKAINFIQ

SEQ ID NO: 215664 - protein, 16 aa, Borrelia afzelii
SQASRNTSKAINFIQT

SEQ ID NO: 215665 - protein, 16 aa, Borrelia afzelii
QASRNTSKAINFIQTT

SEQ ID NO: 215666 - protein, 16 aa, Borrelia afzelii
ASRNTSKAINFIQTTE

SEQ ID NO: 215667 - protein, 16 aa, Borrelia afzelii
SRNTSKAINFIQTTEG

SEQ ID NO: 215668 - protein, 16 aa, Borrelia afzelii
RNTSKAINFIQTTEGN

SEQ ID NO: 215669 - protein, 16 aa, Borrelia afzelii
NTSKAINFIQTTEGNL

SEQ ID NO: 215670 - protein, 16 aa, Borrelia afzelii
TSKAINFIQTTEGNLN

SEQ ID NO: 215671 - protein, 16 aa, Borrelia afzelii
SKAINFIQTTEGNLNE

SEQ ID NO: 215672 - protein, 16 aa, Borrelia afzelii
KAINFIQTTEGNLNEV

SEQ ID NO: 215673 - protein, 16 aa, Borrelia afzelii
AINFIQTTEGNLNEVE

SEQ ID NO: 215674 - protein, 16 aa, Borrelia afzelii
INFIQTTEGNLNEVEK

SEQ ID NO: 215675 - protein, 16 aa, Borrelia afzelii
NFIQTTEGNLNEVEKV

SEQ ID NO: 215676 - protein, 16 aa, Borrelia afzelii
FIQTTEGNLNEVEKVL

SEQ ID NO: 215677 - protein, 16 aa, Borrelia afzelii
IQTTEGNLNEVEKVLV

SEQ ID NO: 215678 - protein, 16 aa, Borrelia afzelii
QTTEGNLNEVEKVLVR

SEQ ID NO: 215679 - protein, 16 aa, Borrelia afzelii
TTEGNLNEVEKVLVRM

SEQ ID NO: 215680 - protein, 16 aa, Borrelia afzelii
TEGNLNEVEKVLVRMK

SEQ ID NO: 215681 - protein, 16 aa, Borrelia afzelii
EGNLNEVEKVLVRMKE

SEQ ID NO: 215682 - protein, 16 aa, Borrelia afzelii
GNLNEVEKVLVRMKEL

SEQ ID NO: 215683 - protein, 16 aa, Borrelia afzelii
NLNEVEKVLVRMKELA

SEQ ID NO: 215684 - protein, 16 aa, Borrelia afzelii
LNEVEKVLVRMKELAV

SEQ ID NO: 215685 - protein, 16 aa, Borrelia afzelii
NEVEKVLVRMKELAVQ

SEQ ID NO: 215686 - protein, 16 aa, Borrelia afzelii
EVEKVLVRMKELAVQS

SEQ ID NO: 215687 - protein, 16 aa, Borrelia afzelii
VEKVLVRMKELAVQSG

SEQ ID NO: 215688 - protein, 16 aa, Borrelia afzelii
EKVLVRMKELAVQSGN

SEQ ID NO: 215689 - protein, 16 aa, Borrelia afzelii
KVLVRMKELAVQSGNG

SEQ ID NO: 215690 - protein, 16 aa, Borrelia afzelii
VLVRMKELAVQSGNGT

SEQ ID NO: 215691 - protein, 16 aa, Borrelia afzelii
LVRMKELAVQSGNGTY

SEQ ID NO: 215692 - protein, 16 aa, Borrelia afzelii
VRMKELAVQSGNGTYS

SEQ ID NO: 215693 - protein, 16 aa, Borrelia afzelii
RMKELAVQSGNGTYSD

SEQ ID NO: 215694 - protein, 16 aa, Borrelia afzelii
MKELAVQSGNGTYSDS

SEQ ID NO: 215695 - protein, 16 aa, Borrelia afzelii
KELAVQSGNGTYSDSD

SEQ ID NO: 215696 - protein, 16 aa, Borrelia afzelii
ELAVQSGNGTYSDSDR

SEQ ID NO: 215697 - protein, 16 aa, Borrelia afzelii
LAVQSGNGTYSDSDRG

SEQ ID NO: 215698 - protein, 16 aa, Borrelia afzelii
AVQSGNGTYSDSDRGS

SEQ ID NO: 215699 - protein, 16 aa, Borrelia afzelii
VQSGNGTYSDSDRGSI

SEQ ID NO: 215700 - protein, 16 aa, Borrelia afzelii
QSGNGTYSDSDRGSIQ

SEQ ID NO: 215701 - protein, 16 aa, Borrelia afzelii
SGNGTYSDSDRGSIQI

SEQ ID NO: 215702 - protein, 16 aa, Borrelia afzelii
GNGTYSDSDRGSIQIE

SEQ ID NO: 215703 - protein, 16 aa, Borrelia afzelii
NGTYSDSDRGSIQIEI

SEQ ID NO: 215704 - protein, 16 aa, Borrelia afzelii
GTYSDSDRGSIQIEIE

SEQ ID NO: 215705 - protein, 16 aa, Borrelia afzelii
TYSDSDRGSIQIEIEQ

SEQ ID NO: 215706 - protein, 16 aa, Borrelia afzelii
YSDSDRGSIQIEIEQL

SEQ ID NO: 215707 - protein, 16 aa, Borrelia afzelii
SDSDRGSIQIEIEQLT

SEQ ID NO: 215708 - protein, 16 aa, Borrelia afzelii
DSDRGSIQIEIEQLTD

SEQ ID NO: 215709 - protein, 16 aa, Borrelia afzelii
SDRGSIQIEIEQLTDE

SEQ ID NO: 215710 - protein, 16 aa, Borrelia afzelii
DRGSIQIEIEQLTDEI

SEQ ID NO: 215711 - protein, 16 aa, Borrelia afzelii
RGSIQIEIEQLTDEIN

SEQ ID NO: 215712 - protein, 16 aa, Borrelia afzelii
GSIQIEIEQLTDEINR

SEQ ID NO: 215713 - protein, 16 aa, Borrelia afzelii
SIQIEIEQLTDEINRI

SEQ ID NO: 215714 - protein, 16 aa, Borrelia afzelii
IQIEIEQLTDEINRIA

SEQ ID NO: 215715 - protein, 16 aa, Borrelia afzelii
QIEIEQLTDEINRIAD

SEQ ID NO: 215716 - protein, 16 aa, Borrelia afzelii
IEIEQLTDEINRIADQ

SEQ ID NO: 215717 - protein, 16 aa, Borrelia afzelii
EIEQLTDEINRIADQA

SEQ ID NO: 215718 - protein, 16 aa, Borrelia afzelii
IEQLTDEINRIADQAQ

SEQ ID NO: 215719 - protein, 16 aa, Borrelia afzelii
EQLTDEINRIADQAQY

SEQ ID NO: 215720 - protein, 16 aa, Borrelia afzelii
QLTDEINRIADQAQYN

SEQ ID NO: 215721 - protein, 16 aa, Borrelia afzelii
LTDEINRIADQAQYNQ

SEQ ID NO: 215722 - protein, 16 aa, Borrelia afzelii
TDEINRIADQAQYNQM

SEQ ID NO: 215723 - protein, 16 aa, Borrelia afzelii
DEINRIADQAQYNQMH

SEQ ID NO: 215724 - protein, 16 aa, Borrelia afzelii
EINRIADQAQYNQMHM

SEQ ID NO: 215725 - protein, 16 aa, Borrelia afzelii
INRIADQAQYNQMHML

SEQ ID NO: 215726 - protein, 16 aa, Borrelia afzelii
NRIADQAQYNQMHMLS

SEQ ID NO: 215727 - protein, 16 aa, Borrelia afzelii
RIADQAQYNQMHMLSN

SEQ ID NO: 215728 - protein, 16 aa, Borrelia afzelii
IADQAQYNQMHMLSNK

SEQ ID NO: 215729 - protein, 16 aa, Borrelia afzelii
ADQAQYNQMHMLSNKS

SEQ ID NO: 215730 - protein, 16 aa, Borrelia afzelii
DQAQYNQMHMLSNKSA

SEQ ID NO: 215731 - protein, 16 aa, Borrelia afzelii
QAQYNQMHMLSNKSAS

SEQ ID NO: 215732 - protein, 16 aa, Borrelia afzelii
AQYNQMHMLSNKSASQ

SEQ ID NO: 215733 - protein, 16 aa, Borrelia afzelii
QYNQMHMLSNKSASQN

SEQ ID NO: 215734 - protein, 16 aa, Borrelia afzelii
YNQMHMLSNKSASQNV

SEQ ID NO: 215735 - protein, 16 aa, Borrelia afzelii
NQMHMLSNKSASQNVK

SEQ ID NO: 215736 - protein, 16 aa, Borrelia afzelii
QMHMLSNKSASQNVKT

SEQ ID NO: 215737 - protein, 16 aa, Borrelia afzelii
MHMLSNKSASQNVKTA

SEQ ID NO: 215738 - protein, 16 aa, Borrelia afzelii
HMLSNKSASQNVKTAE

SEQ ID NO: 215739 - protein, 16 aa, Borrelia afzelii
MLSNKSASQNVKTAEE

SEQ ID NO: 215740 - protein, 16 aa, Borrelia afzelii
LSNKSASQNVKTAEEL

SEQ ID NO: 215741 - protein, 16 aa, Borrelia afzelii
SNKSASQNVKTAEELG

SEQ ID NO: 215742 - protein, 16 aa, Borrelia afzelii
NKSASQNVKTAEELGM

SEQ ID NO: 215743 - protein, 16 aa, Borrelia afzelii
KSASQNVKTAEELGMQ

SEQ ID NO: 215744 - protein, 16 aa, Borrelia afzelii
SASQNVKTAEELGMQP

SEQ ID NO: 215745 - protein, 16 aa, Borrelia afzelii
ASQNVKTAEELGMQPA

SEQ ID NO: 215746 - protein, 16 aa, Borrelia afzelii
SQNVKTAEELGMQPAK

SEQ ID NO: 215747 - protein, 16 aa, Borrelia afzelii
QNVKTAEELGMQPAKI

SEQ ID NO: 215748 - protein, 16 aa, Borrelia afzelii
NVKTAEELGMQPAKIN

SEQ ID NO: 215749 - protein, 16 aa, Borrelia afzelii
VKTAEELGMQPAKINT

SEQ ID NO: 215750 - protein, 16 aa, Borrelia afzelii
KTAEELGMQPAKINTP

SEQ ID NO: 215751 - protein, 16 aa, Borrelia afzelii
TAEELGMQPAKINTPA

SEQ ID NO: 215752 - protein, 16 aa, Borrelia afzelii
AEELGMQPAKINTPAS

SEQ ID NO: 215753 - protein, 16 aa, Borrelia afzelii
EELGMQPAKINTPASL

SEQ ID NO: 215754 - protein, 16 aa, Borrelia afzelii
ELGMQPAKINTPASLS

SEQ ID NO: 215755 - protein, 16 aa, Borrelia afzelii
LGMQPAKINTPASLSG

SEQ ID NO: 215756 - protein, 16 aa, Borrelia afzelii
GMQPAKINTPASLSGS

SEQ ID NO: 215757 - protein, 16 aa, Borrelia afzelii
MQPAKINTPASLSGSQ

SEQ ID NO: 215758 - protein, 16 aa, Borrelia afzelii
QPAKINTPASLSGSQA

SEQ ID NO: 215759 - protein, 16 aa, Borrelia afzelii
PAKINTPASLSGSQAS

SEQ ID NO: 215760 - protein, 16 aa, Borrelia afzelii
AKINTPASLSGSQASW

SEQ ID NO: 215761 - protein, 16 aa, Borrelia afzelii
KINTPASLSGSQASWT

SEQ ID NO: 215762 - protein, 16 aa, Borrelia afzelii
INTPASLSGSQASWTL

SEQ ID NO: 215763 - protein, 16 aa, Borrelia afzelii
NTPASLSGSQASWTLR

SEQ ID NO: 215764 - protein, 16 aa, Borrelia afzelii
TPASLSGSQASWTLRV

SEQ ID NO: 215765 - protein, 16 aa, Borrelia afzelii
PASLSGSQASWTLRVH

SEQ ID NO: 215766 - protein, 16 aa, Borrelia afzelii
ASLSGSQASWTLRVHV

SEQ ID NO: 215767 - protein, 16 aa, Borrelia afzelii
SLSGSQASWTLRVHVG

SEQ ID NO: 215768 - protein, 16 aa, Borrelia afzelii
LSGSQASWTLRVHVGA

SEQ ID NO: 215769 - protein, 16 aa, Borrelia afzelii
SGSQASWTLRVHVGAN

SEQ ID NO: 215770 - protein, 16 aa, Borrelia afzelii
GSQASWTLRVHVGANQ

SEQ ID NO: 215771 - protein, 16 aa, Borrelia afzelii
SQASWTLRVHVGANQD

SEQ ID NO: 215772 - protein, 16 aa, Borrelia afzelii
QASWTLRVHVGANQDE

SEQ ID NO: 215773 - protein, 16 aa, Borrelia afzelii
ASWTLRVHVGANQDEA

SEQ ID NO: 215774 - protein, 16 aa, Borrelia afzelii
SWTLRVHVGANQDEAI

SEQ ID NO: 215775 - protein, 16 aa, Borrelia afzelii
WTLRVHVGANQDEAIA

SEQ ID NO: 215776 - protein, 16 aa, Borrelia afzelii
TLRVHVGANQDEAIAV

SEQ ID NO: 215777 - protein, 16 aa, Borrelia afzelii
LRVHVGANQDEAIAVN

SEQ ID NO: 215778 - protein, 16 aa, Borrelia afzelii
RVHVGANQDEAIAVNI

SEQ ID NO: 215779 - protein, 16 aa, Borrelia afzelii
VHVGANQDEAIAVNIY

SEQ ID NO: 215780 - protein, 16 aa, Borrelia afzelii
HVGANQDEAIAVNIYS

SEQ ID NO: 215781 - protein, 16 aa, Borrelia afzelii
VGANQDEAIAVNIYSA

SEQ ID NO: 215782 - protein, 16 aa, Borrelia afzelii
GANQDEAIAVNIYSAN

SEQ ID NO: 215783 - protein, 16 aa, Borrelia afzelii
ANQDEAIAVNIYSANV

SEQ ID NO: 215784 - protein, 16 aa, Borrelia afzelii
NQDEAIAVNIYSANVA

SEQ ID NO: 215785 - protein, 16 aa, Borrelia afzelii
QDEAIAVNIYSANVAN

SEQ ID NO: 215786 - protein, 16 aa, Borrelia afzelii
DEAIAVNIYSANVANL

SEQ ID NO: 215787 - protein, 16 aa, Borrelia afzelii
EAIAVNIYSANVANLF

SEQ ID NO: 215788 - protein, 16 aa, Borrelia afzelii
AIAVNIYSANVANLFA

SEQ ID NO: 215789 - protein, 16 aa, Borrelia afzelii
IAVNIYSANVANLFAG

SEQ ID NO: 215790 - protein, 16 aa, Borrelia afzelii
AVNIYSANVANLFAGE

SEQ ID NO: 215791 - protein, 16 aa, Borrelia afzelii
VNIYSANVANLFAGEG

SEQ ID NO: 215792 - protein, 16 aa, Borrelia afzelii
NIYSANVANLFAGEGA

SEQ ID NO: 215793 - protein, 16 aa, Borrelia afzelii
IYSANVANLFAGEGAQ

SEQ ID NO: 215794 - protein, 16 aa, Borrelia afzelii
YSANVANLFAGEGAQA

SEQ ID NO: 215795 - protein, 16 aa, Borrelia afzelii
SANVANLFAGEGAQAA

SEQ ID NO: 215796 - protein, 16 aa, Borrelia afzelii
ANVANLFAGEGAQAAQ

SEQ ID NO: 215797 - protein, 16 aa, Borrelia afzelii
NVANLFAGEGAQAAQA

SEQ ID NO: 215798 - protein, 16 aa, Borrelia afzelii
VANLFAGEGAQAAQAA

SEQ ID NO: 215799 - protein, 16 aa, Borrelia afzelii
ANLFAGEGAQAAQAAP

SEQ ID NO: 215800 - protein, 16 aa, Borrelia afzelii
NLFAGEGAQAAQAAPV

SEQ ID NO: 215801 - protein, 16 aa, Borrelia afzelii
LFAGEGAQAAQAAPVQ

SEQ ID NO: 215802 - protein, 16 aa, Borrelia afzelii
FAGEGAQAAQAAPVQE

SEQ ID NO: 215803 - protein, 16 aa, Borrelia afzelii
AGEGAQAAQAAPVQEG

SEQ ID NO: 215804 - protein, 16 aa, Borrelia afzelii
GEGAQAAQAAPVQEGA

SEQ ID NO: 215805 - protein, 16 aa, Borrelia afzelii
EGAQAAQAAPVQEGAQ

SEQ ID NO: 215806 - protein, 16 aa, Borrelia afzelii
GAQAAQAAPVQEGAQE

SEQ ID NO: 215807 - protein, 16 aa, Borrelia afzelii
AQAAQAAPVQEGAQEE

SEQ ID NO: 215808 - protein, 16 aa, Borrelia afzelii
QAAQAAPVQEGAQEEG

SEQ ID NO: 215809 - protein, 16 aa, Borrelia afzelii
AAQAAPVQEGAQEEGA

SEQ ID NO: 215810 - protein, 16 aa, Borrelia afzelii
AQAAPVQEGAQEEGAQ

SEQ ID NO: 215811 - protein, 16 aa, Borrelia afzelii
QAAPVQEGAQEEGAQQ

SEQ ID NO: 215812 - protein, 16 aa, Borrelia afzelii
AAPVQEGAQEEGAQQP

SEQ ID NO: 215813 - protein, 16 aa, Borrelia afzelii
APVQEGAQEEGAQQPT

SEQ ID NO: 215814 - protein, 16 aa, Borrelia afzelii
PVQEGAQEEGAQQPTP

SEQ ID NO: 215815 - protein, 16 aa, Borrelia afzelii
VQEGAQEEGAQQPTPA

SEQ ID NO: 215816 - protein, 16 aa, Borrelia afzelii
QEGAQEEGAQQPTPAT

SEQ ID NO: 215817 - protein, 16 aa, Borrelia afzelii
EGAQEEGAQQPTPATA

SEQ ID NO: 215818 - protein, 16 aa, Borrelia afzelii
GAQEEGAQQPTPATAP

SEQ ID NO: 215819 - protein, 16 aa, Borrelia afzelii
AQEEGAQQPTPATAPT

SEQ ID NO: 215820 - protein, 16 aa, Borrelia afzelii
QEEGAQQPTPATAPTQ

SEQ ID NO: 215821 - protein, 16 aa, Borrelia afzelii
EEGAQQPTPATAPTQG

SEQ ID NO: 215822 - protein, 16 aa, Borrelia afzelii
EGAQQPTPATAPTQGG

SEQ ID NO: 215823 - protein, 16 aa, Borrelia afzelii
GAQQPTPATAPTQGGV

SEQ ID NO: 215824 - protein, 16 aa, Borrelia afzelii
AQQPTPATAPTQGGVN

SEQ ID NO: 215825 - protein, 16 aa, Borrelia afzelii
QQPTPATAPTQGGVNS

SEQ ID NO: 215826 - protein, 16 aa, Borrelia afzelii
QPTPATAPTQGGVNSP

SEQ ID NO: 215827 - protein, 16 aa, Borrelia afzelii
PTPATAPTQGGVNSPV

SEQ ID NO: 215828 - protein, 16 aa, Borrelia afzelii
TPATAPTQGGVNSPVN

SEQ ID NO: 215829 - protein, 16 aa, Borrelia afzelii
PATAPTQGGVNSPVNV

SEQ ID NO: 215830 - protein, 16 aa, Borrelia afzelii
ATAPTQGGVNSPVNVT

SEQ ID NO: 215831 - protein, 16 aa, Borrelia afzelii
TAPTQGGVNSPVNVTT

SEQ ID NO: 215832 - protein, 16 aa, Borrelia afzelii
APTQGGVNSPVNVTTT

SEQ ID NO: 215833 - protein, 16 aa, Borrelia afzelii
PTQGGVNSPVNVTTTV

SEQ ID NO: 215834 - protein, 16 aa, Borrelia afzelii
TQGGVNSPVNVTTTVD

SEQ ID NO: 215835 - protein, 16 aa, Borrelia afzelii
QGGVNSPVNVTTTVDA

SEQ ID NO: 215836 - protein, 16 aa, Borrelia afzelii
GGVNSPVNVTTTVDAN

SEQ ID NO: 215837 - protein, 16 aa, Borrelia afzelii
GVNSPVNVTTTVDANT

SEQ ID NO: 215838 - protein, 16 aa, Borrelia afzelii
VNSPVNVTTTVDANTS

SEQ ID NO: 215839 - protein, 16 aa, Borrelia afzelii
NSPVNVTTTVDANTSL

SEQ ID NO: 215840 - protein, 16 aa, Borrelia afzelii
SPVNVTTTVDANTSLA

SEQ ID NO: 215841 - protein, 16 aa, Borrelia afzelii
PVNVTTTVDANTSLAK

SEQ ID NO: 215842 - protein, 16 aa, Borrelia afzelii
VNVTTTVDANTSLAKI

SEQ ID NO: 215843 - protein, 16 aa, Borrelia afzelii
NVTTTVDANTSLAKIE

SEQ ID NO: 215844 - protein, 16 aa, Borrelia afzelii
VTTTVDANTSLAKIEN

SEQ ID NO: 215845 - protein, 16 aa, Borrelia afzelii
TTTVDANTSLAKIENA

SEQ ID NO: 215846 - protein, 16 aa, Borrelia afzelii
TTVDANTSLAKIENAI

SEQ ID NO: 215847 - protein, 16 aa, Borrelia afzelii
TVDANTSLAKIENAIR

SEQ ID NO: 215848 - protein, 16 aa, Borrelia afzelii
VDANTSLAKIENAIRM

SEQ ID NO: 215849 - protein, 16 aa, Borrelia afzelii
DANTSLAKIENAIRMI

SEQ ID NO: 215850 - protein, 16 aa, Borrelia afzelii
ANTSLAKIENAIRMIS

SEQ ID NO: 215851 - protein, 16 aa, Borrelia afzelii
NTSLAKIENAIRMISD

SEQ ID NO: 215852 - protein, 16 aa, Borrelia afzelii
TSLAKIENAIRMISDQ

SEQ ID NO: 215853 - protein, 16 aa, Borrelia afzelii
SLAKIENAIRMISDQR

SEQ ID NO: 215854 - protein, 16 aa, Borrelia afzelii
LAKIENAIRMISDQRA

SEQ ID NO: 215855 - protein, 16 aa, Borrelia afzelii
AKIENAIRMISDQRAN

SEQ ID NO: 215856 - protein, 16 aa, Borrelia afzelii
KIENAIRMISDQRANL

SEQ ID NO: 215857 - protein, 16 aa, Borrelia afzelii
IENAIRMISDQRANLG

SEQ ID NO: 215858 - protein, 16 aa, Borrelia afzelii
ENAIRMISDQRANLGA

SEQ ID NO: 215859 - protein, 16 aa, Borrelia afzelii
NAIRMISDQRANLGAF

SEQ ID NO: 215860 - protein, 16 aa, Borrelia afzelii
AIRMISDQRANLGAFQ

SEQ ID NO: 215861 - protein, 16 aa, Borrelia afzelii
IRMISDQRANLGAFQN

SEQ ID NO: 215862 - protein, 16 aa, Borrelia afzelii
RMISDQRANLGAFQNR

SEQ ID NO: 215863 - protein, 16 aa, Borrelia afzelii
MISDQRANLGAFQNRL

SEQ ID NO: 215864 - protein, 16 aa, Borrelia afzelii
ISDQRANLGAFQNRLE

SEQ ID NO: 215865 - protein, 16 aa, Borrelia afzelii
SDQRANLGAFQNRLES

SEQ ID NO: 215866 - protein, 16 aa, Borrelia afzelii
DQRANLGAFQNRLESI

SEQ ID NO: 215867 - protein, 16 aa, Borrelia afzelii
QRANLGAFQNRLESIK

SEQ ID NO: 215868 - protein, 16 aa, Borrelia afzelii
RANLGAFQNRLESIKN

SEQ ID NO: 215869 - protein, 16 aa, Borrelia afzelii
ANLGAFQNRLESIKNS

SEQ ID NO: 215870 - protein, 16 aa, Borrelia afzelii
NLGAFQNRLESIKNST

SEQ ID NO: 215871 - protein, 16 aa, Borrelia afzelii
LGAFQNRLESIKNSTE

SEQ ID NO: 215872 - protein, 16 aa, Borrelia afzelii
GAFQNRLESIKNSTEY

SEQ ID NO: 215873 - protein, 16 aa, Borrelia afzelii
AFQNRLESIKNSTEYA

SEQ ID NO: 215874 - protein, 16 aa, Borrelia afzelii
FQNRLESIKNSTEYAI

SEQ ID NO: 215875 - protein, 16 aa, Borrelia afzelii
QNRLESIKNSTEYAIE

SEQ ID NO: 215876 - protein, 16 aa, Borrelia afzelii
NRLESIKNSTEYAIEN

SEQ ID NO: 215877 - protein, 16 aa, Borrelia afzelii
RLESIKNSTEYAIENL

SEQ ID NO: 215878 - protein, 16 aa, Borrelia afzelii
LESIKNSTEYAIENLK

SEQ ID NO: 215879 - protein, 16 aa, Borrelia afzelii
ESIKNSTEYAIENLKA

SEQ ID NO: 215880 - protein, 16 aa, Borrelia afzelii
SIKNSTEYAIENLKAS

SEQ ID NO: 215881 - protein, 16 aa, Borrelia afzelii
IKNSTEYAIENLKASY

SEQ ID NO: 215882 - protein, 16 aa, Borrelia afzelii
KNSTEYAIENLKASYA

SEQ ID NO: 215883 - protein, 16 aa, Borrelia afzelii
NSTEYAIENLKASYAQ

SEQ ID NO: 215884 - protein, 16 aa, Borrelia afzelii
STEYAIENLKASYAQI

SEQ ID NO: 215885 - protein, 16 aa, Borrelia afzelii
TEYAIENLKASYAQIK

SEQ ID NO: 215886 - protein, 16 aa, Borrelia afzelii
EYAIENLKASYAQIKD

SEQ ID NO: 215887 - protein, 16 aa, Borrelia afzelii
YAIENLKASYAQIKDA

SEQ ID NO: 215888 - protein, 16 aa, Borrelia afzelii
AIENLKASYAQIKDAT

SEQ ID NO: 215889 - protein, 16 aa, Borrelia afzelii
IENLKASYAQIKDATM

SEQ ID NO: 215890 - protein, 16 aa, Borrelia afzelii
ENLKASYAQIKDATMT

SEQ ID NO: 215891 - protein, 16 aa, Borrelia afzelii
NLKASYAQIKDATMTD

SEQ ID NO: 215892 - protein, 16 aa, Borrelia afzelii
LKASYAQIKDATMTDE

SEQ ID NO: 215893 - protein, 16 aa, Borrelia afzelii
KASYAQIKDATMTDEV

SEQ ID NO: 215894 - protein, 16 aa, Borrelia afzelii
ASYAQIKDATMTDEVV

SEQ ID NO: 215895 - protein, 16 aa, Borrelia afzelii
SYAQIKDATMTDEVVA

SEQ ID NO: 215896 - protein, 16 aa, Borrelia afzelii
YAQIKDATMTDEVVAA

SEQ ID NO: 215897 - protein, 16 aa, Borrelia afzelii
AQIKDATMTDEVVAAT

SEQ ID NO: 215898 - protein, 16 aa, Borrelia afzelii
QIKDATMTDEVVAATT

SEQ ID NO: 215899 - protein, 16 aa, Borrelia afzelii
IKDATMTDEVVAATTN

SEQ ID NO: 215900 - protein, 16 aa, Borrelia afzelii
KDATMTDEVVAATTNS

SEQ ID NO: 215901 - protein, 16 aa, Borrelia afzelii
DATMTDEVVAATTNSI

SEQ ID NO: 215902 - protein, 16 aa, Borrelia afzelii
ATMTDEVVAATTNSIL

SEQ ID NO: 215903 - protein, 16 aa, Borrelia afzelii
TMTDEVVAATTNSILT

SEQ ID NO: 215904 - protein, 16 aa, Borrelia afzelii
MTDEVVAATTNSILTQ

SEQ ID NO: 215905 - protein, 16 aa, Borrelia afzelii
TDEVVAATTNSILTQS

SEQ ID NO: 215906 - protein, 16 aa, Borrelia afzelii
DEVVAATTNSILTQSA

SEQ ID NO: 215907 - protein, 16 aa, Borrelia afzelii
EVVAATTNSILTQSAM

SEQ ID NO: 215908 - protein, 16 aa, Borrelia afzelii
VVAATTNSILTQSAMA

SEQ ID NO: 215909 - protein, 16 aa, Borrelia afzelii
VAATTNSILTQSAMAM

SEQ ID NO: 215910 - protein, 16 aa, Borrelia afzelii
AATTNSILTQSAMAMI

SEQ ID NO: 215911 - protein, 16 aa, Borrelia afzelii
ATTNSILTQSAMAMIA

SEQ ID NO: 215912 - protein, 16 aa, Borrelia afzelii
TTNSILTQSAMAMIAQ

SEQ ID NO: 215913 - protein, 16 aa, Borrelia afzelii
TNSILTQSAMAMIAQA

SEQ ID NO: 215914 - protein, 16 aa, Borrelia afzelii
NSILTQSAMAMIAQAN

SEQ ID NO: 215915 - protein, 16 aa, Borrelia afzelii
SILTQSAMAMIAQANQ

SEQ ID NO: 215916 - protein, 16 aa, Borrelia afzelii
ILTQSAMAMIAQANQV

SEQ ID NO: 215917 - protein, 16 aa, Borrelia afzelii
LTQSAMAMIAQANQVP

SEQ ID NO: 215918 - protein, 16 aa, Borrelia afzelii
TQSAMAMIAQANQVPQ

SEQ ID NO: 215919 - protein, 16 aa, Borrelia afzelii
QSAMAMIAQANQVPQY

SEQ ID NO: 215920 - protein, 16 aa, Borrelia afzelii
SAMAMIAQANQVPQYV

SEQ ID NO: 215921 - protein, 16 aa, Borrelia afzelii
AMAMIAQANQVPQYVL

SEQ ID NO: 215922 - protein, 16 aa, Borrelia afzelii
MAMIAQANQVPQYVLS

SEQ ID NO: 215923 - protein, 16 aa, Borrelia afzelii
AMIAQANQVPQYVLSL

SEQ ID NO: 215924 - protein, 16 aa, Borrelia afzelii
MIAQANQVPQYVLSLL

SEQ ID NO: 215925 - protein, 16 aa, Borrelia afzelii
IAQANQVPQYVLSLLR

SEQ ID NO: 215926 - protein, 169 aa, Borrelia Burgdorferi; identical to SEQ ID NO: 18

SEQ ID NO: 215927 - protein, 8 aa, Borrelia Burgdorferi
KISLLIFL

SEQ ID NO: 215928 - protein, 8 aa, Borrelia Burgdorferi
ISLLIFLF

SEQ ID NO: 215929 - protein, 8 aa, Borrelia Burgdorferi
SLLIFLFL

SEQ ID NO: 215930 - protein, 8 aa, Borrelia Burgdorferi
LLIFLFLF

SEQ ID NO: 215931 - protein, 8 aa, Borrelia Burgdorferi
LIFLFLFV

SEQ ID NO: 215932 - protein, 8 aa, Borrelia Burgdorferi
IFLFLFVV

SEQ ID NO: 215933 - protein, 8 aa, Borrelia Burgdorferi
FLFLFVVS

SEQ ID NO: 215934 - protein, 8 aa, Borrelia Burgdorferi
LFLFVVSL

SEQ ID NO: 215935 - protein, 8 aa, Borrelia Burgdorferi
FLFVVSLS

SEQ ID NO: 215936 - protein, 8 aa, Borrelia Burgdorferi
SLSANIEE

SEQ ID NO: 215937 - protein, 8 aa, Borrelia Burgdorferi
SANIEENY

SEQ ID NO: 215938 - protein, 8 aa, Borrelia Burgdorferi
EENYTETK

SEQ ID NO: 215939 - protein, 8 aa, Borrelia Burgdorferi
ENYTETKR

SEQ ID NO: 215940 - protein, 8 aa, Borrelia Burgdorferi
YTETKRAF

SEQ ID NO: 215941 - protein, 8 aa, Borrelia Burgdorferi
ETKRAFSK

SEQ ID NO: 215942 - protein, 8 aa, Borrelia Burgdorferi
RAFSKEDF

SEQ ID NO: 215943 - protein, 8 aa, Borrelia Burgdorferi
FSKEDFNL

SEQ ID NO: 215944 - protein, 8 aa, Borrelia Burgdorferi
EDFNLINK

SEQ ID NO: 215945 - protein, 8 aa, Borrelia Burgdorferi
DFNLINKR

SEQ ID NO: 215946 - protein, 8 aa, Borrelia Burgdorferi
KRLDNYDF

SEQ ID NO: 215947 - protein, 8 aa, Borrelia Burgdorferi
RLDNYDFK

SEQ ID NO: 215948 - protein, 8 aa, Borrelia Burgdorferi
DFKNEYEK

SEQ ID NO: 215949 - protein, 8 aa, Borrelia Burgdorferi
EYEKSHVF

SEQ ID NO: 215950 - protein, 8 aa, Borrelia Burgdorferi
HVFSDAPR

SEQ ID NO: 215951 - protein, 8 aa, Borrelia Burgdorferi
APRIRGDL

SEQ ID NO: 215952 - protein, 8 aa, Borrelia Burgdorferi
RIRGDLRK

SEQ ID NO: 215953 - protein, 8 aa, Borrelia Burgdorferi
FLDALEAI

SEQ ID NO: 215954 - protein, 8 aa, Borrelia Burgdorferi
DALEAIEY

SEQ ID NO: 215955 - protein, 8 aa, Borrelia Burgdorferi
ALEAIEYL

SEQ ID NO: 215956 - protein, 8 aa, Borrelia Burgdorferi
LEAIEYLI

SEQ ID NO: 215957 - protein, 8 aa, Borrelia Burgdorferi
EAIEYLIK

SEQ ID NO: 215958 - protein, 8 aa, Borrelia Burgdorferi
EYLIKIKI

SEQ ID NO: 215959 - protein, 8 aa, Borrelia Burgdorferi
KISTDSIF

SEQ ID NO: 215960 - protein, 8 aa, Borrelia Burgdorferi
IFLSEDMI

SEQ ID NO: 215961 - protein, 8 aa, Borrelia Burgdorferi
FLSEDMIR

SEQ ID NO: 215962 - protein, 8 aa, Borrelia Burgdorferi
SEDMIRLI

SEQ ID NO: 215963 - protein, 8 aa, Borrelia Burgdorferi
MIRLIGSY

SEQ ID NO: 215964 - protein, 8 aa, Borrelia Burgdorferi
GSYPDSIF

SEQ ID NO: 215965 - protein, 8 aa, Borrelia Burgdorferi
YPDSIFNY

SEQ ID NO: 215966 - protein, 8 aa, Borrelia Burgdorferi
DSIFNYLI

SEQ ID NO: 215967 - protein, 8 aa, Borrelia Burgdorferi
SIFNYLIQ

SEQ ID NO: 215968 - protein, 8 aa, Borrelia Burgdorferi
LIQLNSDK

SEQ ID NO: 215969 - protein, 8 aa, Borrelia Burgdorferi
IQLNSDKI

SEQ ID NO: 215970 - protein, 8 aa, Borrelia Burgdorferi
KIDYAEKY

SEQ ID NO: 215971 - protein, 8 aa, Borrelia Burgdorferi
AEKYGDNA

SEQ ID NO: 215972 - protein, 8 aa, Borrelia Burgdorferi
EKYGDNAR

SEQ ID NO: 215973 - protein, 8 aa, Borrelia Burgdorferi
DNARNNFK

SEQ ID NO: 215974 - protein, 8 aa, Borrelia Burgdorferi
NARNNFKK

SEQ ID NO: 215975 - protein, 8 aa, Borrelia Burgdorferi
SEDKANTV

SEQ ID NO: 215976 - protein, 8 aa, Borrelia Burgdorferi
NTVKQILK

SEQ ID NO: 215977 - protein, 8 aa, Borrelia Burgdorferi
KQILKQIL

SEQ ID NO: 215978 - protein, 8 aa, Borrelia Burgdorferi
QILKQILA

SEQ ID NO: 215979 - protein, 8 aa, Borrelia Burgdorferi
QILADLPK

SEQ ID NO: 215980 - protein, 9 aa, Borrelia Burgdorferi
KKISLLIFL

SEQ ID NO: 215981 - protein, 9 aa, Borrelia Burgdorferi
KISLLIFLF

SEQ ID NO: 215982 - protein, 9 aa, Borrelia Burgdorferi
SLLIFLFLF

SEQ ID NO: 215983 - protein, 9 aa, Borrelia Burgdorferi
LLIFLFLFV

SEQ ID NO: 215984 - protein, 9 aa, Borrelia Burgdorferi
LIFLFLFVV

SEQ ID NO: 215985 - protein, 9 aa, Borrelia Burgdorferi
FLFLFVVSL

SEQ ID NO: 215986 - protein, 9 aa, Borrelia Burgdorferi
FLFVVSLSA

SEQ ID NO: 215987 - protein, 9 aa, Borrelia Burgdorferi
FVVSLSANI

SEQ ID NO: 215988 - protein, 9 aa, Borrelia Burgdorferi
LSANIEENY

SEQ ID NO: 215989 - protein, 9 aa, Borrelia Burgdorferi
EENYTETKR

SEQ ID NO: 215990 - protein, 9 aa, Borrelia Burgdorferi
NYTETKRAF

SEQ ID NO: 215991 - protein, 9 aa, Borrelia Burgdorferi
ETKRAFSKE

SEQ ID NO: 215992 - protein, 9 aa, Borrelia Burgdorferi
AFSKEDFNL

SEQ ID NO: 215993 - protein, 9 aa, Borrelia Burgdorferi
FSKEDFNLI

SEQ ID NO: 215994 - protein, 9 aa, Borrelia Burgdorferi
EDFNLINKR

SEQ ID NO: 215995 - protein, 9 aa, Borrelia Burgdorferi
LINKRLDNY

SEQ ID NO: 215996 - protein, 9 aa, Borrelia Burgdorferi
KRLDNYDFK

SEQ ID NO: 215997 - protein, 9 aa, Borrelia Burgdorferi
RLDNYDFKN

SEQ ID NO: 215998 - protein, 9 aa, Borrelia Burgdorferi
YDFKNEYEK

SEQ ID NO: 215999 - protein, 9 aa, Borrelia Burgdorferi
NEYEKSHVF

SEQ ID NO: 216000 - protein, 9 aa, Borrelia Burgdorferi
HVFSDAPRI

SEQ ID NO: 216001 - protein, 9 aa, Borrelia Burgdorferi
VFSDAPRIR

SEQ ID NO: 216002 - protein, 9 aa, Borrelia Burgdorferi
RIRGDLRKI

SEQ ID NO: 216003 - protein, 9 aa, Borrelia Burgdorferi
KIGIKEKSV

SEQ ID NO: 216004 - protein, 9 aa, Borrelia Burgdorferi
GIKEKSVFL

SEQ ID NO: 216005 - protein, 9 aa, Borrelia Burgdorferi
SVFLDALEA

SEQ ID NO: 216006 - protein, 9 aa, Borrelia Burgdorferi
FLDALEAIE

SEQ ID NO: 216007 - protein, 9 aa, Borrelia Burgdorferi
DALEAIEYL

SEQ ID NO: 216008 - protein, 9 aa, Borrelia Burgdorferi
ALEAIEYLI

SEQ ID NO: 216009 - protein, 9 aa, Borrelia Burgdorferi
EAIEYLIKI

SEQ ID NO: 216010 - protein, 9 aa, Borrelia Burgdorferi
AIEYLIKIK

SEQ ID NO: 216011 - protein, 9 aa, Borrelia Burgdorferi
IEYLIKIKI

SEQ ID NO: 216012 - protein, 9 aa, Borrelia Burgdorferi
YLIKIKIST

SEQ ID NO: 216013 - protein, 9 aa, Borrelia Burgdorferi
KIKISTDSI

SEQ ID NO: 216014 - protein, 9 aa, Borrelia Burgdorferi
KISTDSIFL

SEQ ID NO: 216015 - protein, 9 aa, Borrelia Burgdorferi
IFLSEDMIR

SEQ ID NO: 216016 - protein, 9 aa, Borrelia Burgdorferi
FLSEDMIRL

SEQ ID NO: 216017 - protein, 9 aa, Borrelia Burgdorferi
DMIRLIGSY

SEQ ID NO: 216018 - protein, 9 aa, Borrelia Burgdorferi
LIGSYPDSI

SEQ ID NO: 216019 - protein, 9 aa, Borrelia Burgdorferi
SYPDSIFNY

SEQ ID NO: 216020 - protein, 9 aa, Borrelia Burgdorferi
YPDSIFNYL

SEQ ID NO: 216021 - protein, 9 aa, Borrelia Burgdorferi
SIFNYLIQL

SEQ ID NO: 216022 - protein, 9 aa, Borrelia Burgdorferi
YLIQLNSDK

SEQ ID NO: 216023 - protein, 9 aa, Borrelia Burgdorferi
QLNSDKIDY

SEQ ID NO: 216024 - protein, 9 aa, Borrelia Burgdorferi
DNARNNFKK

SEQ ID NO: 216025 - protein, 9 aa, Borrelia Burgdorferi
KQILKQILA

SEQ ID NO: 216026 - protein, 9 aa, Borrelia Burgdorferi
ILKQILADL

SEQ ID NO: 216027 - protein, 9 aa, Borrelia Burgdorferi
KQILADLPK

SEQ ID NO: 216028 - protein, 10 aa, Borrelia Burgdorferi
KISLLIFLFL

SEQ ID NO: 216029 - protein, 10 aa, Borrelia Burgdorferi
ISLLIFLFLF

SEQ ID NO: 216030 - protein, 10 aa, Borrelia Burgdorferi
SLLIFLFLFV

SEQ ID NO: 216031 - protein, 10 aa, Borrelia Burgdorferi
LLIFLFLFVV

SEQ ID NO: 216032 - protein, 10 aa, Borrelia Burgdorferi
IFLFLFVVSL

SEQ ID NO: 216033 - protein, 10 aa, Borrelia Burgdorferi
FLFLFVVSLS

SEQ ID NO: 216034 - protein, 10 aa, Borrelia Burgdorferi
FLFVVSLSAN

SEQ ID NO: 216035 - protein, 10 aa, Borrelia Burgdorferi
SLSANIEENY

SEQ ID NO: 216036 - protein, 10 aa, Borrelia Burgdorferi
NIEENYTETK

SEQ ID NO: 216037 - protein, 10 aa, Borrelia Burgdorferi
EENYTETKRA

SEQ ID NO: 216038 - protein, 10 aa, Borrelia Burgdorferi
YTETKRAFSK

SEQ ID NO: 216039 - protein, 10 aa, Borrelia Burgdorferi
RAFSKEDFNL

SEQ ID NO: 216040 - protein, 10 aa, Borrelia Burgdorferi
AFSKEDFNLI

SEQ ID NO: 216041 - protein, 10 aa, Borrelia Burgdorferi
NLINKRLDNY

SEQ ID NO: 216042 - protein, 10 aa, Borrelia Burgdorferi
NYDFKNEYEK

SEQ ID NO: 216043 - protein, 10 aa, Borrelia Burgdorferi
FKNEYEKSHV

SEQ ID NO: 216044 - protein, 10 aa, Borrelia Burgdorferi
KSHVFSDAPR

SEQ ID NO: 216045 - protein, 10 aa, Borrelia Burgdorferi
HVFSDAPRIR

SEQ ID NO: 216046 - protein, 10 aa, Borrelia Burgdorferi
DAPRIRGDLR

SEQ ID NO: 216047 - protein, 10 aa, Borrelia Burgdorferi
KEKSVFLDAL

SEQ ID NO: 216048 - protein, 10 aa, Borrelia Burgdorferi
SVFLDALEAI

SEQ ID NO: 216049 - protein, 10 aa, Borrelia Burgdorferi
FLDALEAIEY

SEQ ID NO: 216050 - protein, 10 aa, Borrelia Burgdorferi
LDALEAIEYL

SEQ ID NO: 216051 - protein, 10 aa, Borrelia Burgdorferi
DALEAIEYLI

SEQ ID NO: 216052 - protein, 10 aa, Borrelia Burgdorferi
ALEAIEYLIK

SEQ ID NO: 216053 - protein, 10 aa, Borrelia Burgdorferi
LEAIEYLIKI

SEQ ID NO: 216054 - protein, 10 aa, Borrelia Burgdorferi
EAIEYLIKIK

SEQ ID NO: 216055 - protein, 10 aa, Borrelia Burgdorferi
KIKISTDSIF

SEQ ID NO: 216056 - protein, 10 aa, Borrelia Burgdorferi
SIFLSEDMIR

SEQ ID NO: 216057 - protein, 10 aa, Borrelia Burgdorferi
IFLSEDMIRL

SEQ ID NO: 216058 - protein, 10 aa, Borrelia Burgdorferi
FLSEDMIRLI

SEQ ID NO: 216059 - protein, 10 aa, Borrelia Burgdorferi
RLIGSYPDSI

SEQ ID NO: 216060 - protein, 10 aa, Borrelia Burgdorferi
GSYPDSIFNY

SEQ ID NO: 216061 - protein, 10 aa, Borrelia Burgdorferi
SYPDSIFNYL

SEQ ID NO: 216062 - protein, 10 aa, Borrelia Burgdorferi
YPDSIFNYLI

SEQ ID NO: 216063 - protein, 10 aa, Borrelia Burgdorferi
NYLIQLNSDK

SEQ ID NO: 216064 - protein, 10 aa, Borrelia Burgdorferi
YLIQLNSDKI

SEQ ID NO: 216065 - protein, 10 aa, Borrelia Burgdorferi
IQLNSDKIDY

SEQ ID NO: 216066 - protein, 10 aa, Borrelia Burgdorferi
QLNSDKIDYA

SEQ ID NO: 216067 - protein, 10 aa, Borrelia Burgdorferi
NSDKIDYAEK

SEQ ID NO: 216068 - protein, 10 aa, Borrelia Burgdorferi
YAEKYGDNAR

SEQ ID NO: 216069 - protein, 10 aa, Borrelia Burgdorferi
KYGDNARNNF

SEQ ID NO: 216070 - protein, 10 aa, Borrelia Burgdorferi
KANTVKQILK

SEQ ID NO: 216071 - protein, 10 aa, Borrelia Burgdorferi
NTVKQILKQI

SEQ ID NO: 216072 - protein, 10 aa, Borrelia Burgdorferi
QILKQILADL

SEQ ID NO: 216073 - protein, 11 aa, Borrelia Burgdorferi
KKISLLIFLFL

SEQ ID NO: 216074 - protein, 11 aa, Borrelia Burgdorferi
KISLLIFLFLF

SEQ ID NO: 216075 - protein, 11 aa, Borrelia Burgdorferi
ISLLIFLFLFV

SEQ ID NO: 216076 - protein, 11 aa, Borrelia Burgdorferi
SLLIFLFLFVV

SEQ ID NO: 216077 - protein, 11 aa, Borrelia Burgdorferi
LIFLFLFVVSL

SEQ ID NO: 216078 - protein, 11 aa, Borrelia Burgdorferi
FLFLFVVSLSA

SEQ ID NO: 216079 - protein, 11 aa, Borrelia Burgdorferi
FLFVVSLSANI

SEQ ID NO: 216080 - protein, 11 aa, Borrelia Burgdorferi
SLSANIEENYT

SEQ ID NO: 216081 - protein, 11 aa, Borrelia Burgdorferi
NIEENYTETKR

SEQ ID NO: 216082 - protein, 11 aa, Borrelia Burgdorferi
EENYTETKRAF

SEQ ID NO: 216083 - protein, 11 aa, Borrelia Burgdorferi
NYTETKRAFSK

SEQ ID NO: 216084 - protein, 11 aa, Borrelia Burgdorferi
ETKRAFSKEDF

SEQ ID NO: 216085 - protein, 11 aa, Borrelia Burgdorferi
RAFSKEDFNLI

SEQ ID NO: 216086 - protein, 11 aa, Borrelia Burgdorferi
FSKEDFNLINK

SEQ ID NO: 216087 - protein, 11 aa, Borrelia Burgdorferi
KEDFNLINKRL

SEQ ID NO: 216088 - protein, 11 aa, Borrelia Burgdorferi
INKRLDNYDFK

SEQ ID NO: 216089 - protein, 11 aa, Borrelia Burgdorferi
RLDNYDFKNEY

SEQ ID NO: 216090 - protein, 11 aa, Borrelia Burgdorferi
DNYDFKNEYEK

SEQ ID NO: 216091 - protein, 11 aa, Borrelia Burgdorferi
FKNEYEKSHVF

SEQ ID NO: 216092 - protein, 11 aa, Borrelia Burgdorferi
EKSHVFSDAPR

SEQ ID NO: 216093 - protein, 11 aa, Borrelia Burgdorferi
KSHVFSDAPRI

SEQ ID NO: 216094 - protein, 11 aa, Borrelia Burgdorferi
DAPRIRGDLRK

SEQ ID NO: 216095 - protein, 11 aa, Borrelia Burgdorferi
APRIRGDLRKI

SEQ ID NO: 216096 - protein, 11 aa, Borrelia Burgdorferi
RIRGDLRKIGI

SEQ ID NO: 216097 - protein, 11 aa, Borrelia Burgdorferi
RKIGIKEKSVF

SEQ ID NO: 216098 - protein, 11 aa, Borrelia Burgdorferi
KIGIKEKSVFL

SEQ ID NO: 216099 - protein, 11 aa, Borrelia Burgdorferi
VFLDALEAIEY

SEQ ID NO: 216100 - protein, 11 aa, Borrelia Burgdorferi
FLDALEAIEYL

SEQ ID NO: 216101 - protein, 11 aa, Borrelia Burgdorferi
ALEAIEYLIKI

SEQ ID NO: 216102 - protein, 11 aa, Borrelia Burgdorferi
EAIEYLIKIKI

SEQ ID NO: 216103 - protein, 11 aa, Borrelia Burgdorferi
IEYLIKIKIST

SEQ ID NO: 216104 - protein, 11 aa, Borrelia Burgdorferi
LIKIKISTDSI

SEQ ID NO: 216105 - protein, 11 aa, Borrelia Burgdorferi
KIKISTDSIFL

SEQ ID NO: 216106 - protein, 11 aa, Borrelia Burgdorferi
STDSIFLSEDM

SEQ ID NO: 216107 - protein, 11 aa, Borrelia Burgdorferi
DSIFLSEDMIR

SEQ ID NO: 216108 - protein, 11 aa, Borrelia Burgdorferi
SIFLSEDMIRL

SEQ ID NO: 216109 - protein, 11 aa, Borrelia Burgdorferi
IFLSEDMIRLI

SEQ ID NO: 216110 - protein, 11 aa, Borrelia Burgdorferi
FLSEDMIRLIG

SEQ ID NO: 216111 - protein, 11 aa, Borrelia Burgdorferi
SEDMIRLIGSY

SEQ ID NO: 216112 - protein, 11 aa, Borrelia Burgdorferi
RLIGSYPDSIF

SEQ ID NO: 216113 - protein, 11 aa, Borrelia Burgdorferi
GSYPDSIFNYL

SEQ ID NO: 216114 - protein, 11 aa, Borrelia Burgdorferi
SYPDSIFNYLI

SEQ ID NO: 216115 - protein, 11 aa, Borrelia Burgdorferi
YPDSIFNYLIQ

SEQ ID NO: 216116 - protein, 11 aa, Borrelia Burgdorferi
FNYLIQLNSDK

SEQ ID NO: 216117 - protein, 11 aa, Borrelia Burgdorferi
NYLIQLNSDKI

SEQ ID NO: 216118 - protein, 11 aa, Borrelia Burgdorferi
IQLNSDKIDYA

SEQ ID NO: 216119 - protein, 11 aa, Borrelia Burgdorferi
NSDKIDYAEKY

SEQ ID NO: 216120 - protein, 11 aa, Borrelia Burgdorferi
DYAEKYGDNAR

SEQ ID NO: 216121 - protein, 11 aa, Borrelia Burgdorferi
KYGDNARNNFK

SEQ ID NO: 216122 - protein, 11 aa, Borrelia Burgdorferi
DYSEDKANTVK

SEQ ID NO: 216123 - protein, 11 aa, Borrelia Burgdorferi
NTVKQILKQIL

SEQ ID NO: 216124 - protein, 11 aa, Borrelia Burgdorferi
KQILKQILADL

SEQ ID NO: 216125 - protein, 11 aa, Borrelia Burgdorferi
ILKQILADLPK

SEQ ID NO: 216126 - protein, 15 aa, Borrelia Burgdorferi
AEKYGDNARNNFKKD

SEQ ID NO: 216127 - protein, 9 aa, Borrelia Burgdorferi
YGDNARNNF

SEQ ID NO: 216128 - protein, 15 aa, Borrelia Burgdorferi
AFSKEDFNLINKRLD

SEQ ID NO: 216129 - protein, 9 aa, Borrelia Burgdorferi
DFNLINKRL

SEQ ID NO: 216130 - protein, 15 aa, Borrelia Burgdorferi
AIEYLIKIKISTDSI

SEQ ID NO: 216131 - protein, 9 aa, Borrelia Burgdorferi
IKIKISTDS

SEQ ID NO: 216132 - protein, 15 aa, Borrelia Burgdorferi
ALEAIEYLIKIKIST

SEQ ID NO: 216133 - protein, 9 aa, Borrelia Burgdorferi
IEYLIKIKI

SEQ ID NO: 216134 - protein, 15 aa, Borrelia Burgdorferi
ARNNFKKDYSEDKAN

SEQ ID NO: 216135 - protein, 9 aa, Borrelia Burgdorferi
FKKDYSEDK

SEQ ID NO: 216136 - protein, 15 aa, Borrelia Burgdorferi
DALEAIEYLIKIKIS

SEQ ID NO: 216137 - protein, 9 aa, Borrelia Burgdorferi
IEYLIKIKI

SEQ ID NO: 216138 - protein, 15 aa, Borrelia Burgdorferi
DFNLINKRLDNYDFK

SEQ ID NO: 216139 - protein, 9 aa, Borrelia Burgdorferi
FNLINKRLD

SEQ ID NO: 216140 - protein, 15 aa, Borrelia Burgdorferi
DFNLINKRLDNYDFK

SEQ ID NO: 216141 - protein, 9 aa, Borrelia Burgdorferi
LINKRLDNY

SEQ ID NO: 216142 - protein, 15 aa, Borrelia Burgdorferi
DLRKIGIKEKSVFLD

SEQ ID NO: 216143 - protein, 9 aa, Borrelia Burgdorferi
IGIKEKSVF

SEQ ID NO: 216144 - protein, 15 aa, Borrelia Burgdorferi
DMIRLIGSYPDSIFN

SEQ ID NO: 216145 - protein, 9 aa, Borrelia Burgdorferi
IRLIGSYPD

SEQ ID NO: 216146 - protein, 15 aa, Borrelia Burgdorferi
DNARNNFKKDYSEDK

SEQ ID NO: 216147 - protein, 9 aa, Borrelia Burgdorferi
RNNFKKDYS

SEQ ID NO: 216148 - protein, 15 aa, Borrelia Burgdorferi
DNYDFKNEYEKSHVF

SEQ ID NO: 216149 - protein, 9 aa, Borrelia Burgdorferi
FKNEYEKSH

SEQ ID NO: 216150 - protein, 15 aa, Borrelia Burgdorferi
DSIFLSEDMIRLIGS

SEQ ID NO: 216151 - protein, 9 aa, Borrelia Burgdorferi
FLSEDMIRL

SEQ ID NO: 216152 - protein, 15 aa, Borrelia Burgdorferi
DSIFNYLIQLNSDKI

SEQ ID NO: 216153 - protein, 9 aa, Borrelia Burgdorferi
IFNYLIQLN

SEQ ID NO: 216154 - protein, 15 aa, Borrelia Burgdorferi
DSIFNYLIQLNSDKI

SEQ ID NO: 216155 - protein, 9 aa, Borrelia Burgdorferi
YLIQLNSDK

SEQ ID NO: 216156 - protein, 15 aa, Borrelia Burgdorferi
DYAEKYGDNARNNFK

SEQ ID NO: 216157 - protein, 9 aa, Borrelia Burgdorferi
YGDNARNNF

SEQ ID NO: 216158 - protein, 15 aa, Borrelia Burgdorferi
EAIEYLIKIKISTDS

SEQ ID NO: 216159 - protein, 9 aa, Borrelia Burgdorferi
IEYLIKIKI

SEQ ID NO: 216160 - protein, 15 aa, Borrelia Burgdorferi
EAIEYLIKIKISTDS

SEQ ID NO: 216161 - protein, 9 aa, Borrelia Burgdorferi
YLIKIKIST

SEQ ID NO: 216162 - protein, 15 aa, Borrelia Burgdorferi
EDFNLINKRLDNYDF

SEQ ID NO: 216163 - protein, 9 aa, Borrelia Burgdorferi
FNLINKRLD

SEQ ID NO: 216164 - protein, 15 aa, Borrelia Burgdorferi
EDFNLINKRLDNYDF

SEQ ID NO: 216165 - protein, 9 aa, Borrelia Burgdorferi
LINKRLDNY

SEQ ID NO: 216166 - protein, 15 aa, Borrelia Burgdorferi
EDMIRLIGSYPDSIF

SEQ ID NO: 216167 - protein, 9 aa, Borrelia Burgdorferi
IRLIGSYPD

SEQ ID NO: 216168 - protein, 15 aa, Borrelia Burgdorferi
EDMIRLIGSYPDSIF

SEQ ID NO: 216169 - protein, 9 aa, Borrelia Burgdorferi
MIRLIGSYP

SEQ ID NO: 216170 - protein, 15 aa, Borrelia Burgdorferi
EKSHVFSDAPRIRGD

SEQ ID NO: 216171 - protein, 9 aa, Borrelia Burgdorferi
VFSDAPRIR

SEQ ID NO: 216172 - protein, 15 aa, Borrelia Burgdorferi
EKYGDNARNNFKKDY

SEQ ID NO: 216173 - protein, 9 aa, Borrelia Burgdorferi
YGDNARNNF

SEQ ID NO: 216174 - protein, 15 aa, Borrelia Burgdorferi
EYLIKIKISTDSIFL

SEQ ID NO: 216175 - protein, 9 aa, Borrelia Burgdorferi
IKIKISTDS

SEQ ID NO: 216176 - protein, 15 aa, Borrelia Burgdorferi
FLFLFVVSLSANIEE

SEQ ID NO: 216177 - protein, 9 aa, Borrelia Burgdorferi
FLFVVSLSA

SEQ ID NO: 216178 - protein, 15 aa, Borrelia Burgdorferi
FLFLFVVSLSANIEE

SEQ ID NO: 216179 - protein, 9 aa, Borrelia Burgdorferi
FVVSLSANI

SEQ ID NO: 216180 - protein, 15 aa, Borrelia Burgdorferi
FLFLFVVSLSANIEE

SEQ ID NO: 216181 - protein, 9 aa, Borrelia Burgdorferi
LFLFVVSLS

SEQ ID NO: 216182 - protein, 15 aa, Borrelia Burgdorferi
FLFLFVVSLSANIEE

SEQ ID NO: 216183 - protein, 9 aa, Borrelia Burgdorferi
VVSLSANIE

SEQ ID NO: 216184 - protein, 15 aa, Borrelia Burgdorferi
FLFVVSLSANIEENY

SEQ ID NO: 216185 - protein, 9 aa, Borrelia Burgdorferi
FLFVVSLSA

SEQ ID NO: 216186 - protein, 15 aa, Borrelia Burgdorferi
FLFVVSLSANIEENY

SEQ ID NO: 216187 - protein, 9 aa, Borrelia Burgdorferi
FVVSLSANI

SEQ ID NO: 216188 - protein, 15 aa, Borrelia Burgdorferi
FLSEDMIRLIGSYPD

SEQ ID NO: 216189 - protein, 9 aa, Borrelia Burgdorferi
EDMIRLIGS

SEQ ID NO: 216190 - protein, 15 aa, Borrelia Burgdorferi
FLSEDMIRLIGSYPD

SEQ ID NO: 216191 - protein, 9 aa, Borrelia Burgdorferi
FLSEDMIRL

SEQ ID NO: 216192 - protein, 15 aa, Borrelia Burgdorferi
FLSEDMIRLIGSYPD

SEQ ID NO: 216193 - protein, 9 aa, Borrelia Burgdorferi
MIRLIGSYP

SEQ ID NO: 216194 - protein, 15 aa, Borrelia Burgdorferi
FNLINKRLDNYDFKN

SEQ ID NO: 216195 - protein, 9 aa, Borrelia Burgdorferi
LINKRLDNY

SEQ ID NO: 216196 - protein, 15 aa, Borrelia Burgdorferi
FNYLIQLNSDKIDYA

SEQ ID NO: 216197 - protein, 9 aa, Borrelia Burgdorferi
LIQLNSDKI

SEQ ID NO: 216198 - protein, 15 aa, Borrelia Burgdorferi
FNYLIQLNSDKIDYA

SEQ ID NO: 216199 - protein, 9 aa, Borrelia Burgdorferi
YLIQLNSDK

SEQ ID NO: 216200 - protein, 15 aa, Borrelia Burgdorferi
FSKEDFNLINKRLDN

SEQ ID NO: 216201 - protein, 9 aa, Borrelia Burgdorferi
FNLINKRLD

SEQ ID NO: 216202 - protein, 15 aa, Borrelia Burgdorferi
FVVSLSANIEENYTE

SEQ ID NO: 216203 - protein, 9 aa, Borrelia Burgdorferi
FVVSLSANI

SEQ ID NO: 216204 - protein, 15 aa, Borrelia Burgdorferi
GDLRKIGIKEKSVFL

SEQ ID NO: 216205 - protein, 9 aa, Borrelia Burgdorferi
IGIKEKSVF

SEQ ID NO: 216206 - protein, 15 aa, Borrelia Burgdorferi
IDYAEKYGDNARNNF

SEQ ID NO: 216207 - protein, 9 aa, Borrelia Burgdorferi
KYGDNARNN

SEQ ID NO: 216208 - protein, 15 aa, Borrelia Burgdorferi
IEYLIKIKISTDSIF

SEQ ID NO: 216209 - protein, 9 aa, Borrelia Burgdorferi
IKIKISTDS

SEQ ID NO: 216210 - protein, 15 aa, Borrelia Burgdorferi
IEYLIKIKISTDSIF

SEQ ID NO: 216211 - protein, 9 aa, Borrelia Burgdorferi
YLIKIKIST

SEQ ID NO: 216212 - protein, 15 aa, Borrelia Burgdorferi
IFLFLFVVSLSANIE

SEQ ID NO: 216213 - protein, 9 aa, Borrelia Burgdorferi
FLFVVSLSA

SEQ ID NO: 216214 - protein, 15 aa, Borrelia Burgdorferi
IFLFLFVVSLSANIE

SEQ ID NO: 216215 - protein, 9 aa, Borrelia Burgdorferi
FVVSLSANI

SEQ ID NO: 216216 - protein, 15 aa, Borrelia Burgdorferi
IFLFLFVVSLSANIE

SEQ ID NO: 216217 - protein, 9 aa, Borrelia Burgdorferi
LFLFVVSLS

SEQ ID NO: 216218 - protein, 15 aa, Borrelia Burgdorferi
IFNYLIQLNSDKIDY

SEQ ID NO: 216219 - protein, 9 aa, Borrelia Burgdorferi
LIQLNSDKI

SEQ ID NO: 216220 - protein, 15 aa, Borrelia Burgdorferi
IFNYLIQLNSDKIDY

SEQ ID NO: 216221 - protein, 9 aa, Borrelia Burgdorferi
YLIQLNSDK

SEQ ID NO: 216222 - protein, 15 aa, Borrelia Burgdorferi
IKIKISTDSIFLSED

SEQ ID NO: 216223 - protein, 9 aa, Borrelia Burgdorferi
IKIKISTDS

SEQ ID NO: 216224 - protein, 15 aa, Borrelia Burgdorferi
IKIKISTDSIFLSED

SEQ ID NO: 216225 - protein, 9 aa, Borrelia Burgdorferi
IKISTDSIF

SEQ ID NO: 216226 - protein, 15 aa, Borrelia Burgdorferi
IRLIGSYPDSIFNYL

SEQ ID NO: 216227 - protein, 9 aa, Borrelia Burgdorferi
IRLIGSYPD

SEQ ID NO: 216228 - protein, 15 aa, Borrelia Burgdorferi
IRLIGSYPDSIFNYL

SEQ ID NO: 216229 - protein, 9 aa, Borrelia Burgdorferi
LIGSYPDSI

SEQ ID NO: 216230 - protein, 15 aa, Borrelia Burgdorferi
ISLLIFLFLFVVSLS

SEQ ID NO: 216231 - protein, 9 aa, Borrelia Burgdorferi
FLFLFVVSL

SEQ ID NO: 216232 - protein, 15 aa, Borrelia Burgdorferi
ISLLIFLFLFVVSLS

SEQ ID NO: 216233 - protein, 9 aa, Borrelia Burgdorferi
ISLLIFLFL

SEQ ID NO: 216234 - protein, 15 aa, Borrelia Burgdorferi
ISLLIFLFLFVVSLS

SEQ ID NO: 216235 - protein, 9 aa, Borrelia Burgdorferi
LIFLFLFVV

SEQ ID NO: 216236 - protein, 15 aa, Borrelia Burgdorferi
ISLLIFLFLFVVSLS

SEQ ID NO: 216237 - protein, 9 aa, Borrelia Burgdorferi
LLIFLFLFV

SEQ ID NO: 216238 - protein, 15 aa, Borrelia Burgdorferi
KEDFNLINKRLDNYD

SEQ ID NO: 216239 - protein, 9 aa, Borrelia Burgdorferi
FNLINKRLD

SEQ ID NO: 216240 - protein, 15 aa, Borrelia Burgdorferi
KEDFNLINKRLDNYD

SEQ ID NO: 216241 - protein, 9 aa, Borrelia Burgdorferi
LINKRLDNY

SEQ ID NO: 216242 - protein, 15 aa, Borrelia Burgdorferi
KISLLIFLFLFVVSL

SEQ ID NO: 216243 - protein, 9 aa, Borrelia Burgdorferi
LIFLFLFVV

SEQ ID NO: 216244 - protein, 15 aa, Borrelia Burgdorferi
KKISLLIFLFLFVVS

SEQ ID NO: 216245 - protein, 9 aa, Borrelia Burgdorferi
LIFLFLFVV

SEQ ID NO: 216246 - protein, 15 aa, Borrelia Burgdorferi
KSHVFSDAPRIRGDL

SEQ ID NO: 216247 - protein, 9 aa, Borrelia Burgdorferi
VFSDAPRIR

SEQ ID NO: 216248 - protein, 15 aa, Borrelia Burgdorferi
LDNYDFKNEYEKSHV

SEQ ID NO: 216249 - protein, 9 aa, Borrelia Burgdorferi
FKNEYEKSH

SEQ ID NO: 216250 - protein, 15 aa, Borrelia Burgdorferi
LEAIEYLIKIKISTD

SEQ ID NO: 216251 - protein, 9 aa, Borrelia Burgdorferi
YLIKIKIST

SEQ ID NO: 216252 - protein, 15 aa, Borrelia Burgdorferi
LFLFVVSLSANIEEN

SEQ ID NO: 216253 - protein, 9 aa, Borrelia Burgdorferi
FLFVVSLSA

SEQ ID NO: 216254 - protein, 15 aa, Borrelia Burgdorferi
LFLFVVSLSANIEEN

SEQ ID NO: 216255 - protein, 9 aa, Borrelia Burgdorferi
FVVSLSANI

SEQ ID NO: 216256 - protein, 15 aa, Borrelia Burgdorferi
LFLFVVSLSANIEEN

SEQ ID NO: 216257 - protein, 9 aa, Borrelia Burgdorferi
LFLFVVSLS

SEQ ID NO: 216258 - protein, 15 aa, Borrelia Burgdorferi
LFVVSLSANIEENYT

SEQ ID NO: 216259 - protein, 9 aa, Borrelia Burgdorferi
FVVSLSANI

SEQ ID NO: 216260 - protein, 15 aa, Borrelia Burgdorferi
LFVVSLSANIEENYT

SEQ ID NO: 216261 - protein, 9 aa, Borrelia Burgdorferi
VVSLSANIE

SEQ ID NO: 216262 - protein, 15 aa, Borrelia Burgdorferi
LIFLFLFVVSLSANI

SEQ ID NO: 216263 - protein, 9 aa, Borrelia Burgdorferi
FLFVVSLSA

SEQ ID NO: 216264 - protein, 15 aa, Borrelia Burgdorferi
LIFLFLFVVSLSANI

SEQ ID NO: 216265 - protein, 9 aa, Borrelia Burgdorferi
LFLFVVSLS

SEQ ID NO: 216266 - protein, 15 aa, Borrelia Burgdorferi
LIFLFLFVVSLSANI

SEQ ID NO: 216267 - protein, 9 aa, Borrelia Burgdorferi
LFVVSLSAN

SEQ ID NO: 216268 - protein, 15 aa, Borrelia Burgdorferi
LIFLFLFVVSLSANI

SEQ ID NO: 216269 - protein, 9 aa, Borrelia Burgdorferi
LIFLFLFVV

SEQ ID NO: 216270 - protein, 15 aa, Borrelia Burgdorferi
LIKIKISTDSIFLSE

SEQ ID NO: 216271 - protein, 9 aa, Borrelia Burgdorferi
IKIKISTDS

SEQ ID NO: 216272 - protein, 15 aa, Borrelia Burgdorferi
LIKIKISTDSIFLSE

SEQ ID NO: 216273 - protein, 9 aa, Borrelia Burgdorferi
IKISTDSIF

SEQ ID NO: 216274 - protein, 15 aa, Borrelia Burgdorferi
LLIFLFLFVVSLSAN

SEQ ID NO: 216275 - protein, 9 aa, Borrelia Burgdorferi
FLFVVSLSA

SEQ ID NO: 216276 - protein, 15 aa, Borrelia Burgdorferi
LLIFLFLFVVSLSAN

SEQ ID NO: 216277 - protein, 9 aa, Borrelia Burgdorferi
LFLFVVSLS

SEQ ID NO: 216278 - protein, 15 aa, Borrelia Burgdorferi
LLIFLFLFVVSLSAN

SEQ ID NO: 216279 - protein, 9 aa, Borrelia Burgdorferi
LIFLFLFVV

SEQ ID NO: 216280 - protein, 15 aa, Borrelia Burgdorferi
LRKIGIKEKSVFLDA

SEQ ID NO: 216281 - protein, 9 aa, Borrelia Burgdorferi
IGIKEKSVF

SEQ ID NO: 216282 - protein, 15 aa, Borrelia Burgdorferi
LSEDMIRLIGSYPDS

SEQ ID NO: 216283 - protein, 9 aa, Borrelia Burgdorferi
IRLIGSYPD

SEQ ID NO: 216284 - protein, 15 aa, Borrelia Burgdorferi
LSEDMIRLIGSYPDS

SEQ ID NO: 216285 - protein, 9 aa, Borrelia Burgdorferi
MIRLIGSYP

SEQ ID NO: 216286 - protein, 15 aa, Borrelia Burgdorferi
MIRLIGSYPDSIFNY

SEQ ID NO: 216287 - protein, 9 aa, Borrelia Burgdorferi
IRLIGSYPD

SEQ ID NO: 216288 - protein, 15 aa, Borrelia Burgdorferi
MKKISLLIFLFLFVV

SEQ ID NO: 216289 - protein, 9 aa, Borrelia Burgdorferi
LLIFLFLFV

SEQ ID NO: 216290 - protein, 15 aa, Borrelia Burgdorferi
NARNNFKKDYSEDKA

SEQ ID NO: 216291 - protein, 9 aa, Borrelia Burgdorferi
FKKDYSEDK

SEQ ID NO: 216292 - protein, 15 aa, Borrelia Burgdorferi
NNFKKDYSEDKANTV

SEQ ID NO: 216293 - protein, 9 aa, Borrelia Burgdorferi
FKKDYSEDK

SEQ ID NO: 216294 - protein, 15 aa, Borrelia Burgdorferi
NTVKQILKQILADLP

SEQ ID NO: 216295 - protein, 9 aa, Borrelia Burgdorferi
VKQILKQIL

SEQ ID NO: 216296 - protein, 15 aa, Borrelia Burgdorferi
NYLIQLNSDKIDYAE

SEQ ID NO: 216297 - protein, 9 aa, Borrelia Burgdorferi
LIQLNSDKI

SEQ ID NO: 216298 - protein, 15 aa, Borrelia Burgdorferi
PDSIFNYLIQLNSDK

SEQ ID NO: 216299 - protein, 9 aa, Borrelia Burgdorferi
IFNYLIQLN

SEQ ID NO: 216300 - protein, 15 aa, Borrelia Burgdorferi
RGDLRKIGIKEKSVF

SEQ ID NO: 216301 - protein, 9 aa, Borrelia Burgdorferi
LRKIGIKEK

SEQ ID NO: 216302 - protein, 15 aa, Borrelia Burgdorferi
RKIGIKEKSVFLDAL

SEQ ID NO: 216303 - protein, 9 aa, Borrelia Burgdorferi
IGIKEKSVF

SEQ ID NO: 216304 - protein, 15 aa, Borrelia Burgdorferi
RLDNYDFKNEYEKSH

SEQ ID NO: 216305 - protein, 9 aa, Borrelia Burgdorferi
YDFKNEYEK

SEQ ID NO: 216306 - protein, 15 aa, Borrelia Burgdorferi
RNNFKKDYSEDKANT

SEQ ID NO: 216307 - protein, 9 aa, Borrelia Burgdorferi
FKKDYSEDK

SEQ ID NO: 216308 - protein, 15 aa, Borrelia Burgdorferi
SEDMIRLIGSYPDSI

SEQ ID NO: 216309 - protein, 9 aa, Borrelia Burgdorferi
IRLIGSYPD

SEQ ID NO: 216310 - protein, 15 aa, Borrelia Burgdorferi
SEDMIRLIGSYPDSI

SEQ ID NO: 216311 - protein, 9 aa, Borrelia Burgdorferi
MIRLIGSYP

SEQ ID NO: 216312 - protein, 15 aa, Borrelia Burgdorferi
SHVFSDAPRIRGDLR

SEQ ID NO: 216313 - protein, 9 aa, Borrelia Burgdorferi
VFSDAPRIR

SEQ ID NO: 216314 - protein, 15 aa, Borrelia Burgdorferi
SIFLSEDMIRLIGSY

SEQ ID NO: 216315 - protein, 9 aa, Borrelia Burgdorferi
FLSEDMIRL

SEQ ID NO: 216316 - protein, 15 aa, Borrelia Burgdorferi
SIFNYLIQLNSDKID

SEQ ID NO: 216317 - protein, 9 aa, Borrelia Burgdorferi
LIQLNSDKI

SEQ ID NO: 216318 - protein, 15 aa, Borrelia Burgdorferi
SIFNYLIQLNSDKID

SEQ ID NO: 216319 - protein, 9 aa, Borrelia Burgdorferi
YLIQLNSDK

SEQ ID NO: 216320 - protein, 15 aa, Borrelia Burgdorferi
SKEDFNLINKRLDNY

SEQ ID NO: 216321 - protein, 9 aa, Borrelia Burgdorferi
DFNLINKRL

SEQ ID NO: 216322 - protein, 15 aa, Borrelia Burgdorferi
SKEDFNLINKRLDNY

SEQ ID NO: 216323 - protein, 9 aa, Borrelia Burgdorferi
FNLINKRLD

SEQ ID NO: 216324 - protein, 15 aa, Borrelia Burgdorferi
SLLIFLFLFVVSLSA

SEQ ID NO: 216325 - protein, 9 aa, Borrelia Burgdorferi
FLFLFVVSL

SEQ ID NO: 216326 - protein, 15 aa, Borrelia Burgdorferi
SLLIFLFLFVVSLSA

SEQ ID NO: 216327 - protein, 9 aa, Borrelia Burgdorferi
LFLFVVSLS

SEQ ID NO: 216328 - protein, 15 aa, Borrelia Burgdorferi
SLLIFLFLFVVSLSA

SEQ ID NO: 216329 - protein, 9 aa, Borrelia Burgdorferi
LIFLFLFVV

SEQ ID NO: 216330 - protein, 15 aa, Borrelia Burgdorferi
TVKQILKQILADLPK

SEQ ID NO: 216331 - protein, 9 aa, Borrelia Burgdorferi
LKQILADLP

SEQ ID NO: 216332 - protein, 15 aa, Borrelia Burgdorferi
VKQILKQILADLPKD

SEQ ID NO: 216333 - protein, 9 aa, Borrelia Burgdorferi
LKQILADLP

SEQ ID NO: 216334 - protein, 15 aa, Borrelia Burgdorferi
YAEKYGDNARNNFKK

SEQ ID NO: 216335 - protein, 9 aa, Borrelia Burgdorferi
YGDNARNNF

SEQ ID NO: 216336 - protein, 15 aa, Borrelia Burgdorferi
YEKSHVFSDAPRIRG

SEQ ID NO: 216337 - protein, 9 aa, Borrelia Burgdorferi
VFSDAPRIR

SEQ ID NO: 216338 - protein, 15 aa, Borrelia Burgdorferi
YLIKIKISTDSIFLS

SEQ ID NO: 216339 - protein, 9 aa, Borrelia Burgdorferi
IKIKISTDS

SEQ ID NO: 216340 - protein, 9 aa, Borrelia
FLSEDMIRL

SEQ ID NO: 216341 - protein, 9 aa, Borrelia
KISTDSIFL

SEQ ID NO: 216342 - protein, 9 aa, Borrelia
FLFILSLSA

SEQ ID NO: 216343 - protein, 9 aa, Borrelia
FLAGYFASK

SEQ ID NO: 216344 - protein, 9 aa, Borrelia
NLVGMTFRA

SEQ ID NO: 216345 - protein, 9 aa, Borrelia
KMYSDGIDI

SEQ ID NO: 216346 - protein, 9 aa, Borrelia
YLAPNNVIT

SEQ ID NO: 216347 - protein, 9 aa, Borrelia
KISMLVDGV

SEQ ID NO: 216348 - protein, 9 aa, Borrelia
NLIGVVFRI

SEQ ID NO: 216349 - protein, 9 aa, Borrelia
NVGDALYLI

SEQ ID NO: 216350 - protein, 9 aa, Borrelia
YANPKLRLV

SEQ ID NO: 216351 - protein, 9 aa, Borrelia
AMTEDAYEV

SEQ ID NO: 216352 - protein, 9 aa, Borrelia
GLNQDQSYI

SEQ ID NO: 216353 - protein, 9 aa, Borrelia
FMYGYEAGA

SEQ ID NO: 216354 - protein, 9 aa, Borrelia
YLAPNNVLV

SEQ ID NO: 216355 - protein, 9 aa, Borrelia
KLNIIKLNI

SEQ ID NO: 216356 - protein, 9 aa, Borrelia
SLNYEIEKI

SEQ ID NO: 216357 - protein, 9 aa, Borrelia
KLNILTTIL

SEQ ID NO: 216358 - protein, 9 aa, Borrelia
YMLISISLL

SEQ ID NO: 216359 - protein, 9 aa, Borrelia
LIDDFAIEL

SEQ ID NO: 216360 - protein, 9 aa, Borrelia
LLSCDVSRL

SEQ ID NO: 216361 - protein, 9 aa, Borrelia
RLESSAQEI

SEQ ID NO: 216362 - protein, 9 aa, Borrelia
FILKAKIKA

SEQ ID NO: 216363 - protein, 9 aa, Borrelia
TTADGIIAI

SEQ ID NO: 216364 - protein, 9 aa, Borrelia
LMLEVVESL

SEQ ID NO: 216365 - protein, 9 aa, Borrelia
LLAACNFGL

SEQ ID NO: 216366 - protein, 9 aa, Borrelia
LLVACSIGL

SEQ ID NO: 216367 - protein, 9 aa, Borrelia
YAGDTILGV

SEQ ID NO: 216368 - protein, 9 aa, Borrelia
VLFEDMNGM

SEQ ID NO: 216369 - protein, 9 aa, Borrelia
LIWSNPNYI

SEQ ID NO: 216370 - protein, 9 aa, Borrelia
SIQIEIEQL

SEQ ID NO: 216371 - protein, 9 aa, Borrelia
NLNEVEKVL

SEQ ID NO: 216372 - protein, 9 aa, Borrelia
SLAKIENAI

SEQ ID NO: 216373 - protein, 9 aa, Borrelia
SQASWTLRV

SEQ ID NO: 216374 - protein, 9 aa, Borrelia
AIAVNIYAA

SEQ ID NO: 216375 - protein, 9 aa, Borrelia
ILKDHIKEV

SEQ ID NO: 216376 - protein, 9 aa, Borrelia
NLIPEYEGL

SEQ ID NO: 216377 - protein, 9 aa, Borrelia
SMGQEVKEI

SEQ ID NO: 216378 - protein, 9 aa, Borrelia
WLLDFASFV

SEQ ID NO: 216379 - protein, 9 aa, Borrelia
YLNTNEDFV

SEQ ID NO: 216380 - protein, 9 aa, Borrelia
FIAYDSADV

SEQ ID NO: 216381 - protein, 9 aa, Borrelia
ALIACKQNV

SEQ ID NO: 216382 - protein, 8 aa, Borrelia
FTKEDTIT

SEQ ID NO: 216383 - protein, 9 aa, Borrelia
KTSTLTISV

SEQ ID NO: 216384 - protein, 9 aa, Borrelia
FTLEGTLAA

SEQ ID NO: 216385 - protein, 9 aa, Borrelia
TLVSKKVTL

SEQ ID NO: 216386 - protein, 9 aa, Borrelia
FLTDGTITV

SEQ ID NO: 216387 - protein, 9 aa, Borrelia
SITDDLNTI

SEQ ID NO: 216388 - protein, 9 aa, Borrelia
KIKDFVFLT

SEQ ID NO: 216389 - protein, 9 aa, Borrelia
KITDSNAFV

SEQ ID NO: 216390 - protein, 9 aa, Borrelia
SVKELTSPV

SEQ ID NO: 216391 - protein, 9 aa, Borrelia
ALTNSVKEL

SEQ ID NO: 216392 - protein, 9 aa, Borrelia
ILMTLFLFI

SEQ ID NO: 216393 - protein, 9 aa, Borrelia
SLLAGAYAI

SEQ ID NO: 216394 - protein, 9 aa, Borrelia
MKMFIICAV

SEQ ID NO: 216395 - protein, 9 aa, Borrelia
FIICAVFVL

SEQ ID NO: 216396 - protein, 9 aa, Borrelia
KFSEFTVNI

SEQ ID NO: 216397 - protein, 9 aa, Borrelia
VIDDALKNI

SEQ ID NO: 216398 - protein, 9 aa, Borrelia
KMKNLIICA

SEQ ID NO: 216399 - protein, 9 aa, Borrelia
LIICAVFVL

SEQ ID NO: 216400 - protein, 10 aa, Borrelia
GMAKDGKFAV

SEQ ID NO: 216401 - protein, 9 aa, Borrelia
KVLGAITGL

SEQ ID NO: 216402 - protein, 9 aa, Borrelia
GLRKVGDSV

SEQ ID NO: 216403 - protein, 9 aa, Borrelia
ILSAIVTAA

SEQ ID NO: 216404 - protein, 9 aa, Borrelia
QILSAIVTA

SEQ ID NO: 216405 - protein, 9 aa, Borrelia
YLIQLNSDK

SEQ ID NO: 216406 - protein, 9 aa, Borrelia
KQILADLPK

SEQ ID NO: 216407 - protein, 9 aa, Borrelia
QLNSDKIDY

SEQ ID NO: 216408 - protein, 9 aa, Borrelia
YLSDLEGLK

SEQ ID NO: 216409 - protein, 9 aa, Borrelia
IVFLSCSGK

SEQ ID NO: 216410 - protein, 9 aa, Borrelia
FLTGYIAAK

SEQ ID NO: 216411 - protein, 9 aa, Borrelia
EIFIKQILK

SEQ ID NO: 216412 - protein, 9 aa, Borrelia
ALYLITGEY

SEQ ID NO: 216413 - protein, 9 aa, Borrelia
FLAGYIAAK

SEQ ID NO: 216414 - protein, 9 aa, Borrelia
KEMARFMYK

SEQ ID NO: 216415 - protein, 9 aa, Borrelia
YIAAKMSRK

SEQ ID NO: 216416 - protein, 9 aa, Borrelia
FLAGYFASK

SEQ ID NO: 216417 - protein, 9 aa, Borrelia
SLMYSLTKK

SEQ ID NO: 216418 - protein, 9 aa, Borrelia
RSTASNMYR

SEQ ID NO: 216419 - protein, 9 aa, Borrelia
RIIYSSLNY

SEQ ID NO: 216420 - protein, 9 aa, Borrelia
SSLNYEIEK

SEQ ID NO: 216421 - protein, 9 aa, Borrelia
RSRYNNFYK

SEQ ID NO: 216422 - protein, 9 aa, Borrelia
ESFDVISSK

SEQ ID NO: 216423 - protein, 9 aa, Borrelia
LIALKCIVK

SEQ ID NO: 216424 - protein, 9 aa, Borrelia
KARLESSVK

SEQ ID NO: 216425 - protein, 9 aa, Borrelia
IIAIVKVMK

SEQ ID NO: 216426 - protein, 9 aa, Borrelia
FTNTQTGSK

SEQ ID NO: 216427 - protein, 9 aa, Borrelia
VTSGGLALR

SEQ ID NO: 216428 - protein, 9 aa, Borrelia
FTGLKTGSK

SEQ ID NO: 216429 - protein, 9 aa, Borrelia
LFEAFTGLK

SEQ ID NO: 216430 - protein, 9 aa, Borrelia
KLKAHETFK

SEQ ID NO: 216431 - protein, 9 aa, Borrelia
RFKAFRVSK

SEQ ID NO: 216432 - protein, 9 aa, Borrelia
RVSKSHSSK

SEQ ID NO: 216433 - protein, 9 aa, Borrelia
SINAANLSK

SEQ ID NO: 216434 - protein, 9 aa, Borrelia
SQASRNTSK

SEQ ID NO: 216435 - protein, 9 aa, Borrelia
FQNRLESIK

SEQ ID NO: 216436 - protein, 9 aa, Borrelia
NQMHMLSNK

SEQ ID NO: 216437 - protein, 9 aa, Borrelia
GSQASWTLR

SEQ ID NO: 216438 - protein, 9 aa, Borrelia
KINTPASLS

SEQ ID NO: 216439 - protein, 9 aa, Borrelia
KLISLIRFK

SEQ ID NO: 216440 - protein, 9 aa, Borrelia
HINYPIYIK

SEQ ID NO: 216441 - protein, 9 aa, Borrelia
LLTSGMPSK

SEQ ID NO: 216442 - protein, 9 aa, Borrelia
RSFEKFKKK

SEQ ID NO: 216443 - protein, 9 aa, Borrelia
FLFASSQSY

SEQ ID NO: 216444 - protein, 9 aa, Borrelia
RINLNLKRK

SEQ ID NO: 216445 - protein, 9 aa, Borrelia
ISVNSQKTK

SEQ ID NO: 216446 - protein, 9 aa, Borrelia
NIGQKALKY

SEQ ID NO: 216447 - protein, 9 aa, Borrelia
LTISVNSKK

SEQ ID NO: 216448 - protein, 9 aa, Borrelia
VTLSKNISK

SEQ ID NO: 216449 - protein, 9 aa, Borrelia
LILALIACK

SEQ ID NO: 216450 - protein, 9 aa, Borrelia
KTKNLVFTK

SEQ ID NO: 216451 - protein, 9 aa, Borrelia
RTNGTTLEY

SEQ ID NO: 216452 - protein, 9 aa, Borrelia
MTDADNATK

SEQ ID NO: 216453 - protein, 9 aa, Borrelia
ATKAVETLK

SEQ ID NO: 216454 - protein, 9 aa, Borrelia
TLTISADSK

SEQ ID NO: 216455 - protein, 9 aa, Borrelia
VTLKKEIEK

SEQ ID NO: 216456 - protein, 9 aa, Borrelia
ILMTLFLFI

SEQ ID NO: 216457 - protein, 9 aa, Borrelia
AISTLITEK

SEQ ID NO: 216458 - protein, 9 aa, Borrelia
TLITEKLSK

SEQ ID NO: 216459 - protein, 9 aa, Borrelia
ELANKAIGK

SEQ ID NO: 216460 - protein, 9 aa, Borrelia
LANKAIGKK

SEQ ID NO: 216461 - protein, 9 aa, Borrelia
KTSLYYGYK

SEQ ID NO: 216462 - protein, 9 aa, Borrelia
GSFKTSLYY

SEQ ID NO: 216463 - protein, 9 aa, Borrelia
NLGTLVIRK

SEQ ID NO: 216464 - protein, 9 aa, Borrelia
GTNTNDFVK

SEQ ID NO: 216465 - protein, 9 aa, Borrelia
VFVLIISCK

SEQ ID NO: 216466 - protein, 9 aa, Borrelia
AVSGEQILK

SEQ ID NO: 216467 - protein, 9 aa, Borrelia
AIVLRGLAK

SEQ ID NO: 216468 - protein, 9 aa, Borrelia
AIALRGMAK

SEQ ID NO: 216469 - protein, 9 aa, Borrelia
QIAAAIALR

SEQ ID NO: 216470 - protein, 8 aa, Homo sapiens
HLADSPAV

SEQ ID NO: 216471 - protein, 8 aa, Homo sapiens
FLTGMTVA

SEQ ID NO: 216472 - protein, 8 aa, Homo sapiens
AAWMATYL

SEQ ID NO: 216473 - protein, 8 aa, Homo sapiens
VLVSRIAA

SEQ ID NO: 216474 - protein, 8 aa, Homo sapiens
YQSFEQVV

SEQ ID NO: 216475 - protein, 8 aa, Homo sapiens
GALCVESV

SEQ ID NO: 216476 - protein, 8 aa, Homo sapiens
VLLGSLFS

SEQ ID NO: 216477 - protein, 8 aa, Homo sapiens
FLTGMTVA

SEQ ID NO: 216478 - protein, 8 aa, Homo sapiens
HLADSPAV

SEQ ID NO: 216479 - protein, 8 aa, Homo sapiens
YQSFEQVV

SEQ ID NO: 216480 - protein, 8 aa, Homo sapiens
TVAGVVLL

SEQ ID NO: 216481 - protein, 8 aa, Homo sapiens
FLSYKLSQ

SEQ ID NO: 216482 - protein, 8 aa, Homo sapiens
MAAVKQAL

SEQ ID NO: 216483 - protein, 8 aa, Homo sapiens
SLDAREVI

SEQ ID NO: 216484 - protein, 8 aa, Homo sapiens
ELYGNNAA

SEQ ID NO: 216485 - protein, 8 aa, Homo sapiens
MTVAGVVL

SEQ ID NO: 216486 - protein, 8 aa, Homo sapiens
VLVSRIAA

SEQ ID NO: 216487 - protein, 8 aa, Homo sapiens
SQSNRELV

SEQ ID NO: 216488 - protein, 8 aa, Homo sapiens
FLTGMTVA

SEQ ID NO: 216489 - protein, 8 aa, Homo sapiens
HLADSPAV

SEQ ID NO: 216490 - protein, 8 aa, Homo sapiens
VLVSRIAA

SEQ ID NO: 216491 - protein, 8 aa, Homo sapiens
MQVLVSRI

SEQ ID NO: 216492 - protein, 8 aa, Homo sapiens
FLSYKLSQ

SEQ ID NO: 216493 - protein, 8 aa, Homo sapiens
GVNWGRIV

SEQ ID NO: 216494 - protein, 8 aa, Homo sapiens
GMTVAGVV

SEQ ID NO: 216495 - protein, 8 aa, Homo sapiens
YQSFEQVV

SEQ ID NO: 216496 - protein, 8 aa, Homo sapiens
RIAAWMAT

SEQ ID NO: 216497 - protein, 8 aa, Homo sapiens
EVIPMAAV

SEQ ID NO: 216498 - protein, 8 aa, Homo sapiens
SQSNRELV

SEQ ID NO: 216499 - protein, 8 aa, Homo sapiens
MTVAGVVL

SEQ ID NO: 216500 - protein, 8 aa, Homo sapiens
GALCVESV

SEQ ID NO: 216501 - protein, 8 aa, Homo sapiens
GVVLLGSL

SEQ ID NO: 216502 - protein, 8 aa, Homo sapiens
TVAGVVLL

SEQ ID NO: 216503 - protein, 8 aa, Homo sapiens
HLADSPAV

SEQ ID NO: 216504 - protein, 8 aa, Homo sapiens
SVDKEMQV

SEQ ID NO: 216505 - protein, 8 aa, Homo sapiens
HLADSPAV

SEQ ID NO: 216506 - protein, 8 aa, Homo sapiens
MQVLVSRI

SEQ ID NO: 216507 - protein, 8 aa, Homo sapiens
FLTGMTVA

SEQ ID NO: 216508 - protein, 8 aa, Homo sapiens
SQSNRELV

SEQ ID NO: 216509 - protein, 8 aa, Homo sapiens
YQSFEQVV

SEQ ID NO: 216510 - protein, 8 aa, Homo sapiens
RIVAFFSF

SEQ ID NO: 216511 - protein, 8 aa, Homo sapiens
RIAAWMAT

SEQ ID NO: 216512 - protein, 8 aa, Homo sapiens
GALCVESV

SEQ ID NO: 216513 - protein, 8 aa, Homo sapiens
AAWMATYL

SEQ ID NO: 216514 - protein, 8 aa, Homo sapiens
MTVAGVVL

SEQ ID NO: 216515 - protein, 8 aa, Homo sapiens
VLVSRIAA

SEQ ID NO: 216516 - protein, 8 aa, Homo sapiens
SEMETPSA

SEQ ID NO: 216517 - protein, 8 aa, Homo sapiens
EVIPMAAV

SEQ ID NO: 216518 - protein, 8 aa, Homo sapiens
SVDKEMQV

SEQ ID NO: 216519 - protein, 8 aa, Homo sapiens
HLADSPAV

SEQ ID NO: 216520 - protein, 8 aa, Homo sapiens
SVDKEMQV

SEQ ID NO: 216521 - protein, 8 aa, Homo sapiens
FLTGMTVA

SEQ ID NO: 216522 - protein, 8 aa, Homo sapiens
SLDAREVI

SEQ ID NO: 216523 - protein, 8 aa, Homo sapiens
ELYGNNAA

SEQ ID NO: 216524 - protein, 8 aa, Homo sapiens
TVAGVVLL

SEQ ID NO: 216525 - protein, 8 aa, Homo sapiens
YLNDHLEP

SEQ ID NO: 216526 - protein, 8 aa, Homo sapiens
EVIPMAAV

SEQ ID NO: 216527 - protein, 8 aa, Homo sapiens
GMTVAGVV

SEQ ID NO: 216528 - protein, 8 aa, Homo sapiens
VLVSRIAA

SEQ ID NO: 216529 - protein, 8 aa, Homo sapiens
VLLGSLFS

SEQ ID NO: 216530 - protein, 8 aa, Homo sapiens
GVNWGRIV

SEQ ID NO: 216531 - protein, 8 aa, Homo sapiens
WFLTGMTV

SEQ ID NO: 216532 - protein, 8 aa, Homo sapiens
SFGGALCV

SEQ ID NO: 216533 - protein, 8 aa, Homo sapiens
SSLDAREV

SEQ ID NO: 216534 - protein, 8 aa, Homo sapiens
DLTSQLHI

SEQ ID NO: 216535 - protein, 8 aa, Homo sapiens
YQSFEQVV

SEQ ID NO: 216536 - protein, 8 aa, Homo sapiens
PMAAVKQA

SEQ ID NO: 216537 - protein, 8 aa, Homo sapiens
FLSYKLSQ

SEQ ID NO: 216538 - protein, 8 aa, Homo sapiens
AAWMATYL

SEQ ID NO: 216539 - protein, 8 aa, Homo sapiens
SQSNRELV

SEQ ID NO: 216540 - protein, 8 aa, Homo sapiens
GALCVESV

SEQ ID NO: 216541 - protein, 8 aa, Homo sapiens
HLADSPAV

SEQ ID NO: 216542 - protein, 8 aa, Homo sapiens
ELYGNNAA

SEQ ID NO: 216543 - protein, 8 aa, Homo sapiens
FLTGMTVA

SEQ ID NO: 216544 - protein, 8 aa, Homo sapiens
SVDKEMQV

SEQ ID NO: 216545 - protein, 8 aa, Homo sapiens
SLDAREVI

SEQ ID NO: 216546 - protein, 8 aa, Homo sapiens
VLVSRIAA

SEQ ID NO: 216547 - protein, 8 aa, Homo sapiens
YLNDHLEP

SEQ ID NO: 216548 - protein, 8 aa, Homo sapiens
YQSFEQVV

SEQ ID NO: 216549 - protein, 8 aa, Homo sapiens
EVIPMAAV

SEQ ID NO: 216550 - protein, 8 aa, Homo sapiens
VLLGSLFS

SEQ ID NO: 216551 - protein, 8 aa, Homo sapiens
FLSYKLSQ

SEQ ID NO: 216552 - protein, 8 aa, Homo sapiens
WFLTGMTV

SEQ ID NO: 216553 - protein, 8 aa, Homo sapiens
GMTVAGVV

SEQ ID NO: 216554 - protein, 8 aa, Homo sapiens
HLADSPAV

SEQ ID NO: 216555 - protein, 8 aa, Homo sapiens
SVDKEMQV

SEQ ID NO: 216556 - protein, 8 aa, Homo sapiens
FLTGMTVA

SEQ ID NO: 216557 - protein, 8 aa, Homo sapiens
ELYGNNAA

SEQ ID NO: 216558 - protein, 8 aa, Homo sapiens
EVIPMAAV

SEQ ID NO: 216559 - protein, 8 aa, Homo sapiens
TVAGVVLL

SEQ ID NO: 216560 - protein, 8 aa, Homo sapiens
SLDAREVI

SEQ ID NO: 216561 - protein, 8 aa, Homo sapiens
SFGGALCV

SEQ ID NO: 216562 - protein, 8 aa, Homo sapiens
GMTVAGVV

SEQ ID NO: 216563 - protein, 8 aa, Homo sapiens
AAWMATYL

SEQ ID NO: 216564 - protein, 8 aa, Homo sapiens
VLVSRIAA

SEQ ID NO: 216565 - protein, 8 aa, Homo sapiens
WFLTGMTV

SEQ ID NO: 216566 - protein, 8 aa, Homo sapiens
FLSYKLSQ

SEQ ID NO: 216567 - protein, 8 aa, Homo sapiens
DLTSQLHI

SEQ ID NO: 216568 - protein, 8 aa, Homo sapiens
GVNWGRIV

SEQ ID NO: 216569 - protein, 8 aa, Homo sapiens
PMAAVKQA

SEQ ID NO: 216570 - protein, 8 aa, Homo sapiens
AYQSFEQV

SEQ ID NO: 216571 - protein, 8 aa, Homo sapiens
VLLGSLFS

SEQ ID NO: 216572 - protein, 8 aa, Homo sapiens
GALCVESV

SEQ ID NO: 216573 - protein, 8 aa, Homo sapiens
HLADSPAV

SEQ ID NO: 216574 - protein, 8 aa, Homo sapiens
FLTGMTVA

SEQ ID NO: 216575 - protein, 8 aa, Homo sapiens
SVDKEMQV

SEQ ID NO: 216576 - protein, 8 aa, Homo sapiens
SLDAREVI

SEQ ID NO: 216577 - protein, 8 aa, Homo sapiens
TVAGVVLL

SEQ ID NO: 216578 - protein, 8 aa, Homo sapiens
ELYGNNAA

SEQ ID NO: 216579 - protein, 8 aa, Homo sapiens
WFLTGMTV

SEQ ID NO: 216580 - protein, 8 aa, Homo sapiens
AAWMATYL

SEQ ID NO: 216581 - protein, 8 aa, Homo sapiens
DLTSQLHI

SEQ ID NO: 216582 - protein, 8 aa, Homo sapiens
VLLGSLFS

SEQ ID NO: 216583 - protein, 8 aa, Homo sapiens
LSYKLSQK

SEQ ID NO: 216584 - protein, 8 aa, Homo sapiens
VVDFLSYK

SEQ ID NO: 216585 - protein, 8 aa, Homo sapiens
LLGSLFSR

SEQ ID NO: 216586 - protein, 8 aa, Homo sapiens
VVDFLSYK

SEQ ID NO: 216587 - protein, 8 aa, Homo sapiens
LSYKLSQK

SEQ ID NO: 216588 - protein, 8 aa, Homo sapiens
VIPMAAVK

SEQ ID NO: 216589 - protein, 8 aa, Homo sapiens
QVVNELFR

SEQ ID NO: 216590 - protein, 8 aa, Homo sapiens
LVVDFLSY

SEQ ID NO: 216591 - protein, 8 aa, Homo sapiens
NAAAESRK

SEQ ID NO: 216592 - protein, 8 aa, Homo sapiens
NWGRIVAF

SEQ ID NO: 216593 - protein, 8 aa, Homo sapiens
RIVAFFSF

SEQ ID NO: 216594 - protein, 8 aa, Homo sapiens
VVLLGSLF

SEQ ID NO: 216595 - protein, 8 aa, Homo sapiens
NWGRIVAF

SEQ ID NO: 216596 - protein, 8 aa, Homo sapiens
AYQSFEQV

SEQ ID NO: 216597 - protein, 8 aa, Homo sapiens
EVIPMAAV

SEQ ID NO: 216598 - protein, 8 aa, Homo sapiens
LVVDFLSY

SEQ ID NO: 216599 - protein, 8 aa, Homo sapiens
EVIPMAAV

SEQ ID NO: 216600 - protein, 8 aa, Homo sapiens
LVVDFLSY

SEQ ID NO: 216601 - protein, 8 aa, Homo sapiens
HITPGTAY

SEQ ID NO: 216602 - protein, 8 aa, Homo sapiens
ELRYRRAF

SEQ ID NO: 216603 - protein, 8 aa, Homo sapiens
RIVAFFSF

SEQ ID NO: 216604 - protein, 8 aa, Homo sapiens
HITPGTAY

SEQ ID NO: 216605 - protein, 8 aa, Homo sapiens
LVVDFLSY

SEQ ID NO: 216606 - protein, 8 aa, Homo sapiens
KGQERFNR

SEQ ID NO: 216607 - protein, 8 aa, Homo sapiens
LLGSLFSR

SEQ ID NO: 216608 - protein, 8 aa, Homo sapiens
EMQVLVSR

SEQ ID NO: 216609 - protein, 8 aa, Homo sapiens
HSSSLDAR

SEQ ID NO: 216610 - protein, 8 aa, Homo sapiens
AAVKQALR

SEQ ID NO: 216611 - protein, 8 aa, Homo sapiens
EFELRYRR

SEQ ID NO: 216612 - protein, 8 aa, Homo sapiens
QVVNELFR

SEQ ID NO: 216613 - protein, 8 aa, Homo sapiens
LSYKLSQK

SEQ ID NO: 216614 - protein, 8 aa, Homo sapiens
EFELRYRR

SEQ ID NO: 216615 - protein, 8 aa, Homo sapiens
EMQVLVSR

SEQ ID NO: 216616 - protein, 8 aa, Homo sapiens
DEFELRYR

SEQ ID NO: 216617 - protein, 8 aa, Homo sapiens
ESRKGQER

SEQ ID NO: 216618 - protein, 8 aa, Homo sapiens
LLGSLFSR

SEQ ID NO: 216619 - protein, 8 aa, Homo sapiens
HSSSLDAR

SEQ ID NO: 216620 - protein, 8 aa, Homo sapiens
QVVNELFR

SEQ ID NO: 216621 - protein, 8 aa, Homo sapiens
HSSSLDAR

SEQ ID NO: 216622 - protein, 8 aa, Homo sapiens
NAAAESRK

SEQ ID NO: 216623 - protein, 8 aa, Homo sapiens
LSYKLSQK

SEQ ID NO: 216624 - protein, 8 aa, Homo sapiens
EMQVLVSR

SEQ ID NO: 216625 - protein, 8 aa, Homo sapiens
NNAAAESR

SEQ ID NO: 216626 - protein, 8 aa, Homo sapiens
AAVKQALR

SEQ ID NO: 216627 - protein, 8 aa, Homo sapiens
ESRKGQER

SEQ ID NO: 216628 - protein, 8 aa, Homo sapiens
IAAWMATY

SEQ ID NO: 216629 - protein, 8 aa, Homo sapiens
EFELRYRR

SEQ ID NO: 216630 - protein, 8 aa, Homo sapiens
TAYQSFEQ

SEQ ID NO: 216631 - protein, 8 aa, Homo sapiens
VVDFLSYK

SEQ ID NO: 216632 - protein, 8 aa, Homo sapiens
DEFELRYR

SEQ ID NO: 216633 - protein, 8 aa, Homo sapiens
FSDVEENR

SEQ ID NO: 216634 - protein, 8 aa, Homo sapiens
LLGSLFSR

SEQ ID NO: 216635 - protein, 8 aa, Homo sapiens
EVIPMAAV

SEQ ID NO: 216636 - protein, 8 aa, Homo sapiens
TVAGVVLL

SEQ ID NO: 216637 - protein, 8 aa, Homo sapiens
TGMTVAGV

SEQ ID NO: 216638 - protein, 8 aa, Homo sapiens
MTVAGVVL

SEQ ID NO: 216639 - protein, 8 aa, Homo sapiens
MAAVKQAL

SEQ ID NO: 216640 - protein, 8 aa, Homo sapiens
HLADSPAV

SEQ ID NO: 216641 - protein, 8 aa, Homo sapiens
ERFNRWFL

SEQ ID NO: 216642 - protein, 8 aa, Homo sapiens
DSPAVNGA

SEQ ID NO: 216643 - protein, 8 aa, Homo sapiens
ELYGNNAA

SEQ ID NO: 216644 - protein, 8 aa, Homo sapiens
EAGDEFEL

SEQ ID NO: 216645 - protein, 8 aa, Homo sapiens
EVIPMAAV

SEQ ID NO: 216646 - protein, 8 aa, Homo sapiens
HLADSPAV

SEQ ID NO: 216647 - protein, 8 aa, Homo sapiens
ELYGNNAA

SEQ ID NO: 216648 - protein, 8 aa, Homo sapiens
MTVAGVVL

SEQ ID NO: 216649 - protein, 8 aa, Homo sapiens
TVAGVVLL

SEQ ID NO: 216650 - protein, 8 aa, Homo sapiens
EAGDEFEL

SEQ ID NO: 216651 - protein, 8 aa, Homo sapiens
SVDKEMQV

SEQ ID NO: 216652 - protein, 8 aa, Homo sapiens
WFLTGMTV

SEQ ID NO: 216653 - protein, 8 aa, Homo sapiens
SPAVNGAT

SEQ ID NO: 216654 - protein, 8 aa, Homo sapiens
MAAVKQAL

SEQ ID NO: 216655 - protein, 8 aa, Homo sapiens
AAWMATYL

SEQ ID NO: 216656 - protein, 8 aa, Homo sapiens
ELRYRRAF

SEQ ID NO: 216657 - protein, 8 aa, Homo sapiens
LVVDFLSY

SEQ ID NO: 216658 - protein, 8 aa, Homo sapiens
RIVAFFSF

SEQ ID NO: 216659 - protein, 8 aa, Homo sapiens
HITPGTAY

SEQ ID NO: 216660 - protein, 8 aa, Homo sapiens
IAAWMATY

SEQ ID NO: 216661 - protein, 8 aa, Homo sapiens
ELRYRRAF

SEQ ID NO: 216662 - protein, 8 aa, Homo sapiens
VVLLGSLF

SEQ ID NO: 216663 - protein, 8 aa, Homo sapiens
QERFNRWF

SEQ ID NO: 216664 - protein, 8 aa, Homo sapiens
RELVVDFL

SEQ ID NO: 216665 - protein, 8 aa, Homo sapiens
FEQVVNEL

SEQ ID NO: 216666 - protein, 8 aa, Homo sapiens
NRWFLTGM

SEQ ID NO: 216667 - protein, 8 aa, Homo sapiens
IAAWMATY

SEQ ID NO: 216668 - protein, 8 aa, Homo sapiens
LVVDFLSY

SEQ ID NO: 216669 - protein, 8 aa, Homo sapiens
MAAVKQAL

SEQ ID NO: 216670 - protein, 8 aa, Homo sapiens
HITPGTAY

SEQ ID NO: 216671 - protein, 8 aa, Homo sapiens
DAREVIPM

SEQ ID NO: 216672 - protein, 8 aa, Homo sapiens
FFSFGGAL

SEQ ID NO: 216673 - protein, 8 aa, Homo sapiens
SPAVNGAT

SEQ ID NO: 216674 - protein, 8 aa, Homo sapiens
AAWMATYL

SEQ ID NO: 216675 - protein, 8 aa, Homo sapiens
MTVAGVVL

SEQ ID NO: 216676 - protein, 8 aa, Homo sapiens
RELVVDFL

SEQ ID NO: 216677 - protein, 8 aa, Homo sapiens
FEQVVNEL

SEQ ID NO: 216678 - protein, 8 aa, Homo sapiens
RELVVDFL

SEQ ID NO: 216679 - protein, 8 aa, Homo sapiens
KEMQVLVS

SEQ ID NO: 216680 - protein, 8 aa, Homo sapiens
REVIPMAA

SEQ ID NO: 216681 - protein, 8 aa, Homo sapiens
LVSRIAAW

SEQ ID NO: 216682 - protein, 8 aa, Homo sapiens
IAAWMATY

SEQ ID NO: 216683 - protein, 8 aa, Homo sapiens
LSQKGYSW

SEQ ID NO: 216684 - protein, 8 aa, Homo sapiens
KGYSWSQF

SEQ ID NO: 216685 - protein, 8 aa, Homo sapiens
RIVAFFSF

SEQ ID NO: 216686 - protein, 8 aa, Homo sapiens
AINGNPSW

SEQ ID NO: 216687 - protein, 9 aa, Homo sapiens
FSDLTSQLH

SEQ ID NO: 216688 - protein, 9 aa, Homo sapiens
FSFGGALCV

SEQ ID NO: 216689 - protein, 9 aa, Homo sapiens
MTVAGVVLL

SEQ ID NO: 216690 - protein, 9 aa, Homo sapiens
YLNDHLEPW

SEQ ID NO: 216691 - protein, 9 aa, Homo sapiens
MTVAGVVLL

SEQ ID NO: 216692 - protein, 9 aa, Homo sapiens
IAAWMATYL

SEQ ID NO: 216693 - protein, 9 aa, Homo sapiens
FLTGMTVAG

SEQ ID NO: 216694 - protein, 9 aa, Homo sapiens
FLSYKLSQK

SEQ ID NO: 216695 - protein, 9 aa, Homo sapiens
LVSRIAAWM

SEQ ID NO: 216696 - protein, 9 aa, Homo sapiens
VVDFLSYKL

SEQ ID NO: 216697 - protein, 9 aa, Homo sapiens
ELYGNNAAA

SEQ ID NO: 216698 - protein, 9 aa, Homo sapiens
PMAAVKQAL

SEQ ID NO: 216699 - protein, 9 aa, Homo sapiens
GMTVAGVVL

SEQ ID NO: 216700 - protein, 9 aa, Homo sapiens
LTGMTVAGV

SEQ ID NO: 216701 - protein, 9 aa, Homo sapiens
MTVAGVVLL

SEQ ID NO: 216702 - protein, 9 aa, Homo sapiens
IAAWMATYL

SEQ ID NO: 216703 - protein, 9 aa, Homo sapiens
AVKQALREA

SEQ ID NO: 216704 - protein, 9 aa, Homo sapiens
QLHITPGTA

SEQ ID NO: 216705 - protein, 9 aa, Homo sapiens
YLNDHLEPW

SEQ ID NO: 216706 - protein, 9 aa, Homo sapiens
TAYQSFEQV

SEQ ID NO: 216707 - protein, 9 aa, Homo sapiens
FLSYKLSQK

SEQ ID NO: 216708 - protein, 9 aa, Homo sapiens
LTGMTVAGV

SEQ ID NO: 216709 - protein, 9 aa, Homo sapiens
MTVAGVVLL

SEQ ID NO: 216710 - protein, 9 aa, Homo sapiens
SQLHITPGT

SEQ ID NO: 216711 - protein, 9 aa, Homo sapiens
MTVAGVVLL

SEQ ID NO: 216712 - protein, 9 aa, Homo sapiens
TAYQSFEQV

SEQ ID NO: 216713 - protein, 9 aa, Homo sapiens
SQSNRELVV

SEQ ID NO: 216714 - protein, 9 aa, Homo sapiens
FSFGGALCV

SEQ ID NO: 216715 - protein, 9 aa, Homo sapiens
REVIPMAAV

SEQ ID NO: 216716 - protein, 9 aa, Homo sapiens
IAAWMATYL

SEQ ID NO: 216717 - protein, 9 aa, Homo sapiens
MQVLVSRIA

SEQ ID NO: 216718 - protein, 9 aa, Homo sapiens
LTGMTVAGV

SEQ ID NO: 216719 - protein, 9 aa, Homo sapiens
YLNDHLEPW

SEQ ID NO: 216720 - protein, 9 aa, Homo sapiens
SEMETPSAI

SEQ ID NO: 216721 - protein, 9 aa, Homo sapiens
ELYGNNAAA

SEQ ID NO: 216722 - protein, 9 aa, Homo sapiens
FSFGGALCV

SEQ ID NO: 216723 - protein, 9 aa, Homo sapiens
PMAAVKQAL

SEQ ID NO: 216724 - protein, 9 aa, Homo sapiens
YLNDHLEPW

SEQ ID NO: 216725 - protein, 9 aa, Homo sapiens
SVDKEMQVL

SEQ ID NO: 216726 - protein, 9 aa, Homo sapiens
VVDFLSYKL

SEQ ID NO: 216727 - protein, 9 aa, Homo sapiens
MTVAGVVLL

SEQ ID NO: 216728 - protein, 9 aa, Homo sapiens
HITPGTAYQ

SEQ ID NO: 216729 - protein, 9 aa, Homo sapiens
TAYQSFEQV

SEQ ID NO: 216730 - protein, 9 aa, Homo sapiens
VLLGSLFSR

SEQ ID NO: 216731 - protein, 9 aa, Homo sapiens
FLTGMTVAG

SEQ ID NO: 216732 - protein, 9 aa, Homo sapiens
GVNWGRIVA

SEQ ID NO: 216733 - protein, 9 aa, Homo sapiens
GMTVAGVVL

SEQ ID NO: 216734 - protein, 9 aa, Homo sapiens
GGWDTFVEL

SEQ ID NO: 216735 - protein, 9 aa, Homo sapiens
AFSDLTSQL

SEQ ID NO: 216736 - protein, 9 aa, Homo sapiens
HLEPWIQEN

SEQ ID NO: 216737 - protein, 9 aa, Homo sapiens
ELYGNNAAA

SEQ ID NO: 216738 - protein, 9 aa, Homo sapiens
PMAAVKQAL

SEQ ID NO: 216739 - protein, 9 aa, Homo sapiens
FSFGGALCV

SEQ ID NO: 216740 - protein, 9 aa, Homo sapiens
YLNDHLEPW

SEQ ID NO: 216741 - protein, 9 aa, Homo sapiens
VLLGSLFSR

SEQ ID NO: 216742 - protein, 9 aa, Homo sapiens
VVDFLSYKL

SEQ ID NO: 216743 - protein, 9 aa, Homo sapiens
SVDKEMQVL

SEQ ID NO: 216744 - protein, 9 aa, Homo sapiens
FLTGMTVAG

SEQ ID NO: 216745 - protein, 9 aa, Homo sapiens
AYQSFEQVV

SEQ ID NO: 216746 - protein, 9 aa, Homo sapiens
ELYGNNAAA

SEQ ID NO: 216747 - protein, 9 aa, Homo sapiens
PMAAVKQAL

SEQ ID NO: 216748 - protein, 9 aa, Homo sapiens
FSFGGALCV

SEQ ID NO: 216749 - protein, 9 aa, Homo sapiens
TAYQSFEQV

SEQ ID NO: 216750 - protein, 9 aa, Homo sapiens
HITPGTAYQ

SEQ ID NO: 216751 - protein, 9 aa, Homo sapiens
GMTVAGVVL

SEQ ID NO: 216752 - protein, 9 aa, Homo sapiens
PMAAVKQAL

SEQ ID NO: 216753 - protein, 9 aa, Homo sapiens
FSFGGALCV

SEQ ID NO: 216754 - protein, 9 aa, Homo sapiens
ELYGNNAAA

SEQ ID NO: 216755 - protein, 9 aa, Homo sapiens
TAYQSFEQV

SEQ ID NO: 216756 - protein, 9 aa, Homo sapiens
YLNDHLEPW

SEQ ID NO: 216757 - protein, 9 aa, Homo sapiens
VLLGSLFSR

SEQ ID NO: 216758 - protein, 9 aa, Homo sapiens
LTGMTVAGV

SEQ ID NO: 216759 - protein, 9 aa, Homo sapiens
LLGSLFSRK

SEQ ID NO: 216760 - protein, 9 aa, Homo sapiens
FLSYKLSQK

SEQ ID NO: 216761 - protein, 9 aa, Homo sapiens
RIAAWMATY

SEQ ID NO: 216762 - protein, 9 aa, Homo sapiens
VLLGSLFSR

SEQ ID NO: 216763 - protein, 9 aa, Homo sapiens
LVVDFLSYK

SEQ ID NO: 216764 - protein, 9 aa, Homo sapiens
LVVDFLSYK

SEQ ID NO: 216765 - protein, 9 aa, Homo sapiens
LLGSLFSRK

SEQ ID NO: 216766 - protein, 9 aa, Homo sapiens
VLLGSLFSR

SEQ ID NO: 216767 - protein, 9 aa, Homo sapiens
RIAAWMATY

SEQ ID NO: 216768 - protein, 9 aa, Homo sapiens
ALCVESVDK

SEQ ID NO: 216769 - protein, 9 aa, Homo sapiens
EVIPMAAVK

SEQ ID NO: 216770 - protein, 9 aa, Homo sapiens
FLSYKLSQK

SEQ ID NO: 216771 - protein, 9 aa, Homo sapiens
RYRRAFSDL

SEQ ID NO: 216772 - protein, 9 aa, Homo sapiens
NWGRIVAFF

SEQ ID NO: 216773 - protein, 9 aa, Homo sapiens
GRIVAFFSF

SEQ ID NO: 216774 - protein, 9 aa, Homo sapiens
NWGRIVAFF

SEQ ID NO: 216775 - protein, 9 aa, Homo sapiens
RYRRAFSDL

SEQ ID NO: 216776 - protein, 9 aa, Homo sapiens
RYRRAFSDL

SEQ ID NO: 216777 - protein, 9 aa, Homo sapiens
SFEQVVNEL

SEQ ID NO: 216778 - protein, 9 aa, Homo sapiens
AYQSFEQVV

SEQ ID NO: 216779 - protein, 9 aa, Homo sapiens
ELVVDFLSY

SEQ ID NO: 216780 - protein, 9 aa, Homo sapiens
RIAAWMATY

SEQ ID NO: 216781 - protein, 9 aa, Homo sapiens
RIAAWMATY

SEQ ID NO: 216782 - protein, 9 aa, Homo sapiens
ELVVDFLSY

SEQ ID NO: 216783 - protein, 9 aa, Homo sapiens
LVSRIAAWM

SEQ ID NO: 216784 - protein, 9 aa, Homo sapiens
SVDKEMQVL

SEQ ID NO: 216785 - protein, 9 aa, Homo sapiens
EVIPMAAVK

SEQ ID NO: 216786 - protein, 9 aa, Homo sapiens
MTVAGVVLL

SEQ ID NO: 216787 - protein, 9 aa, Homo sapiens
LHITPGTAY

SEQ ID NO: 216788 - protein, 9 aa, Homo sapiens
ELVVDFLSY

SEQ ID NO: 216789 - protein, 9 aa, Homo sapiens
RIAAWMATY

SEQ ID NO: 216790 - protein, 9 aa, Homo sapiens
MAAVKQALR

SEQ ID NO: 216791 - protein, 9 aa, Homo sapiens
VLLGSLFSR

SEQ ID NO: 216792 - protein, 9 aa, Homo sapiens
LVVDFLSYK

SEQ ID NO: 216793 - protein, 9 aa, Homo sapiens
KEMQVLVSR

SEQ ID NO: 216794 - protein, 9 aa, Homo sapiens
DEFELRYRR

SEQ ID NO: 216795 - protein, 9 aa, Homo sapiens
MAAVKQALR

SEQ ID NO: 216796 - protein, 9 aa, Homo sapiens
ELRYRRAFS

SEQ ID NO: 216797 - protein, 9 aa, Homo sapiens
VLLGSLFSR

SEQ ID NO: 216798 - protein, 9 aa, Homo sapiens
EAGDEFELR

SEQ ID NO: 216799 - protein, 9 aa, Homo sapiens
QFSDVEENR

SEQ ID NO: 216800 - protein, 9 aa, Homo sapiens
EVIPMAAVK

SEQ ID NO: 216801 - protein, 9 aa, Homo sapiens
MAAVKQALR

SEQ ID NO: 216802 - protein, 9 aa, Homo sapiens
LVVDFLSYK

SEQ ID NO: 216803 - protein, 9 aa, Homo sapiens
EAGDEFELR

SEQ ID NO: 216804 - protein, 9 aa, Homo sapiens
EQVVNELFR

SEQ ID NO: 216805 - protein, 9 aa, Homo sapiens
FLSYKLSQK

SEQ ID NO: 216806 - protein, 9 aa, Homo sapiens
DEFELRYRR

SEQ ID NO: 216807 - protein, 9 aa, Homo sapiens
QFSDVEENR

SEQ ID NO: 216808 - protein, 9 aa, Homo sapiens
NNAAAESRK

SEQ ID NO: 216809 - protein, 9 aa, Homo sapiens
VLLGSLFSR

SEQ ID NO: 216810 - protein, 9 aa, Homo sapiens
MTVAGVVLL

SEQ ID NO: 216811 - protein, 9 aa, Homo sapiens
TAYQSFEQV

SEQ ID NO: 216812 - protein, 9 aa, Homo sapiens
TGMTVAGVV

SEQ ID NO: 216813 - protein, 9 aa, Homo sapiens
MSQSNRELV

SEQ ID NO: 216814 - protein, 9 aa, Homo sapiens
YSWSQFSDV

SEQ ID NO: 216815 - protein, 9 aa, Homo sapiens
FSFGGALCV

SEQ ID NO: 216816 - protein, 9 aa, Homo sapiens
ESVDKEMQV

SEQ ID NO: 216817 - protein, 9 aa, Homo sapiens
MATYLNDHL

SEQ ID NO: 216818 - protein, 9 aa, Homo sapiens
ELYGNNAAA

SEQ ID NO: 216819 - protein, 9 aa, Homo sapiens
VAFFSFGGA

SEQ ID NO: 216820 - protein, 9 aa, Homo sapiens
LTGMTVAGV

SEQ ID NO: 216821 - protein, 9 aa, Homo sapiens
IAAWMATYL

SEQ ID NO: 216822 - protein, 9 aa, Homo sapiens
MTVAGVVLL

SEQ ID NO: 216823 - protein, 9 aa, Homo sapiens
TAYQSFEQV

SEQ ID NO: 216824 - protein, 9 aa, Homo sapiens
ELYGNNAAA

SEQ ID NO: 216825 - protein, 9 aa, Homo sapiens
FSFGGALCV

SEQ ID NO: 216826 - protein, 9 aa, Homo sapiens
LTGMTVAGV

SEQ ID NO: 216827 - protein, 9 aa, Homo sapiens
YSWSQFSDV

SEQ ID NO: 216828 - protein, 9 aa, Homo sapiens
APEGTESEM

SEQ ID NO: 216829 - protein, 9 aa, Homo sapiens
SPAVNGATG

SEQ ID NO: 216830 - protein, 9 aa, Homo sapiens
TPGTAYQSF

SEQ ID NO: 216831 - protein, 9 aa, Homo sapiens
FELRYRRAF

SEQ ID NO: 216832 - protein, 9 aa, Homo sapiens
RIAAWMATY

SEQ ID NO: 216833 - protein, 9 aa, Homo sapiens
ALREAGDEF

SEQ ID NO: 216834 - protein, 9 aa, Homo sapiens
FELRYRRAF

SEQ ID NO: 216835 - protein, 9 aa, Homo sapiens
QERFNRWFL

SEQ ID NO: 216836 - protein, 9 aa, Homo sapiens
FEQVVNELF

SEQ ID NO: 216837 - protein, 9 aa, Homo sapiens
QENGGWDTF

SEQ ID NO: 216838 - protein, 9 aa, Homo sapiens
GRIVAFFSF

SEQ ID NO: 216839 - protein, 9 aa, Homo sapiens
RRAFSDLTS

SEQ ID NO: 216840 - protein, 9 aa, Homo sapiens
TPGTAYQSF

SEQ ID NO: 216841 - protein, 9 aa, Homo sapiens
IAAWMATYL

SEQ ID NO: 216842 - protein, 9 aa, Homo sapiens
APEGTESEM

SEQ ID NO: 216843 - protein, 9 aa, Homo sapiens
ELVVDFLSY

SEQ ID NO: 216844 - protein, 9 aa, Homo sapiens
LHITPGTAY

SEQ ID NO: 216845 - protein, 9 aa, Homo sapiens
NPSWHLADS

SEQ ID NO: 216846 - protein, 9 aa, Homo sapiens
RIAAWMATY

SEQ ID NO: 216847 - protein, 9 aa, Homo sapiens
REAGDEFEL

SEQ ID NO: 216848 - protein, 9 aa, Homo sapiens
QERFNRWFL

SEQ ID NO: 216849 - protein, 9 aa, Homo sapiens
QENGGWDTF

SEQ ID NO: 216850 - protein, 9 aa, Homo sapiens
FEQVVNELF

SEQ ID NO: 216851 - protein, 9 aa, Homo sapiens
FELRYRRAF

SEQ ID NO: 216852 - protein, 9 aa, Homo sapiens
SEMETPSAI

SEQ ID NO: 216853 - protein, 9 aa, Homo sapiens
FELRYRRAF

SEQ ID NO: 216854 - protein, 9 aa, Homo sapiens
QENGGWDTF

SEQ ID NO: 216855 - protein, 9 aa, Homo sapiens
SEMETPSAI

SEQ ID NO: 216856 - protein, 9 aa, Homo sapiens
RELVVDFLS

SEQ ID NO: 216857 - protein, 9 aa, Homo sapiens
REVIPMAAV

SEQ ID NO: 216858 - protein, 9 aa, Homo sapiens
IAAWMATYL

SEQ ID NO: 216859 - protein, 9 aa, Homo sapiens
IPMAAVKQA

SEQ ID NO: 216860 - protein, 9 aa, Homo sapiens
SAINGNPSW

SEQ ID NO: 216861 - protein, 9 aa, Homo sapiens
KLSQKGYSW

SEQ ID NO: 216862 - protein, 9 aa, Homo sapiens
IAAWMATYL

SEQ ID NO: 216863 - protein, 9 aa, Homo sapiens
YLNDHLEPW

SEQ ID NO: 216864 - protein, 10 aa, Homo sapiens
FSDLTSQLHI

SEQ ID NO: 216865 - protein, 10 aa, Homo sapiens
YLNDHLEPWI

SEQ ID NO: 216866 - protein, 10 aa, Homo sapiens
FLTGMTVAGV

SEQ ID NO: 216867 - protein, 10 aa, Homo sapiens
RIAAWMATYL

SEQ ID NO: 216868 - protein, 10 aa, Homo sapiens
WMATYLNDHL

SEQ ID NO: 216869 - protein, 10 aa, Homo sapiens
LVVDFLSYKL

SEQ ID NO: 216870 - protein, 10 aa, Homo sapiens
SLDAREVIPM

SEQ ID NO: 216871 - protein, 10 aa, Homo sapiens
VLVSRIAAWM

SEQ ID NO: 216872 - protein, 10 aa, Homo sapiens
SVDKEMQVLV

SEQ ID NO: 216873 - protein, 10 aa, Homo sapiens
GMTVAGVVLL

SEQ ID NO: 216874 - protein, 10 aa, Homo sapiens
FLTGMTVAGV

SEQ ID NO: 216875 - protein, 10 aa, Homo sapiens
WMATYLNDHL

SEQ ID NO: 216876 - protein, 10 aa, Homo sapiens
RIAAWMATYL

SEQ ID NO: 216877 - protein, 10 aa, Homo sapiens
LVVDFLSYKL

SEQ ID NO: 216878 - protein, 10 aa, Homo sapiens
RAFSDLTSQL

SEQ ID NO: 216879 - protein, 10 aa, Homo sapiens
SLDAREVIPM

SEQ ID NO: 216880 - protein, 10 aa, Homo sapiens
YLNDHLEPWI

SEQ ID NO: 216881 - protein, 10 aa, Homo sapiens
GMTVAGVVLL

SEQ ID NO: 216882 - protein, 10 aa, Homo sapiens
FGGALCVESV

SEQ ID NO: 216883 - protein, 10 aa, Homo sapiens
VLVSRIAAWM

SEQ ID NO: 216884 - protein, 10 aa, Homo sapiens
FLTGMTVAGV

SEQ ID NO: 216885 - protein, 10 aa, Homo sapiens
YLNDHLEPWI

SEQ ID NO: 216886 - protein, 10 aa, Homo sapiens
RIAAWMATYL

SEQ ID NO: 216887 - protein, 10 aa, Homo sapiens
WMATYLNDHL

SEQ ID NO: 216888 - protein, 10 aa, Homo sapiens
VLVSRIAAWM

SEQ ID NO: 216889 - protein, 10 aa, Homo sapiens
IVAFFSFGGA

SEQ ID NO: 216890 - protein, 10 aa, Homo sapiens
LVVDFLSYKL

SEQ ID NO: 216891 - protein, 10 aa, Homo sapiens
VVNELFRDGV

SEQ ID NO: 216892 - protein, 10 aa, Homo sapiens
GMTVAGVVLL

SEQ ID NO: 216893 - protein, 10 aa, Homo sapiens
RAFSDLTSQL

SEQ ID NO: 216894 - protein, 10 aa, Homo sapiens
LTGMTVAGVV

SEQ ID NO: 216895 - protein, 10 aa, Homo sapiens
GTAYQSFEQV

SEQ ID NO: 216896 - protein, 10 aa, Homo sapiens
FLTGMTVAGV

SEQ ID NO: 216897 - protein, 10 aa, Homo sapiens
YLNDHLEPWI

SEQ ID NO: 216898 - protein, 10 aa, Homo sapiens
SLDAREVIPM

SEQ ID NO: 216899 - protein, 10 aa, Homo sapiens
RIAAWMATYL

SEQ ID NO: 216900 - protein, 10 aa, Homo sapiens
LVVDFLSYKL

SEQ ID NO: 216901 - protein, 10 aa, Homo sapiens
AINGNPSWHL

SEQ ID NO: 216902 - protein, 10 aa, Homo sapiens
FLTGMTVAGV

SEQ ID NO: 216903 - protein, 10 aa, Homo sapiens
RIAAWMATYL

SEQ ID NO: 216904 - protein, 10 aa, Homo sapiens
YLNDHLEPWI

SEQ ID NO: 216905 - protein, 10 aa, Homo sapiens
MQVLVSRIAA

SEQ ID NO: 216906 - protein, 10 aa, Homo sapiens
LVVDFLSYKL

SEQ ID NO: 216907 - protein, 10 aa, Homo sapiens
WMATYLNDHL

SEQ ID NO: 216908 - protein, 10 aa, Homo sapiens
SQLHITPGTA

SEQ ID NO: 216909 - protein, 10 aa, Homo sapiens
GTAYQSFEQV

SEQ ID NO: 216910 - protein, 10 aa, Homo sapiens
SVDKEMQVLV

SEQ ID NO: 216911 - protein, 10 aa, Homo sapiens
RAFSDLTSQL

SEQ ID NO: 216912 - protein, 10 aa, Homo sapiens
KEMQVLVSRI

SEQ ID NO: 216913 - protein, 10 aa, Homo sapiens
IQENGGWDTF

SEQ ID NO: 216914 - protein, 10 aa, Homo sapiens
IVAFFSFGGA

SEQ ID NO: 216915 - protein, 10 aa, Homo sapiens
VVNELFRDGV

SEQ ID NO: 216916 - protein, 10 aa, Homo sapiens
TAYQSFEQVV

SEQ ID NO: 216917 - protein, 10 aa, Homo sapiens
FLTGMTVAGV

SEQ ID NO: 216918 - protein, 10 aa, Homo sapiens
YLNDHLEPWI

SEQ ID NO: 216919 - protein, 10 aa, Homo sapiens
SVDKEMQVLV

SEQ ID NO: 216920 - protein, 10 aa, Homo sapiens
SLDAREVIPM

SEQ ID NO: 216921 - protein, 10 aa, Homo sapiens
GMTVAGVVLL

SEQ ID NO: 216922 - protein, 10 aa, Homo sapiens
LVVDFLSYKL

SEQ ID NO: 216923 - protein, 10 aa, Homo sapiens
RIAAWMATYL

SEQ ID NO: 216924 - protein, 10 aa, Homo sapiens
VVNELFRDGV

SEQ ID NO: 216925 - protein, 10 aa, Homo sapiens
AINGNPSWHL

SEQ ID NO: 216926 - protein, 10 aa, Homo sapiens
WMATYLNDHL

SEQ ID NO: 216927 - protein, 10 aa, Homo sapiens
TAYQSFEQVV

SEQ ID NO: 216928 - protein, 10 aa, Homo sapiens
VLVSRIAAWM

SEQ ID NO: 216929 - protein, 10 aa, Homo sapiens
FFSFGGALCV

SEQ ID NO: 216930 - protein, 10 aa, Homo sapiens
VLLGSLFSRK

SEQ ID NO: 216931 - protein, 10 aa, Homo sapiens
RAFSDLTSQL

SEQ ID NO: 216932 - protein, 10 aa, Homo sapiens
GTAYQSFEQV

SEQ ID NO: 216933 - protein, 10 aa, Homo sapiens
FLTGMTVAGV

SEQ ID NO: 216934 - protein, 10 aa, Homo sapiens
YLNDHLEPWI

SEQ ID NO: 216935 - protein, 10 aa, Homo sapiens
SVDKEMQVLV

SEQ ID NO: 216936 - protein, 10 aa, Homo sapiens
WMATYLNDHL

SEQ ID NO: 216937 - protein, 10 aa, Homo sapiens
VVNELFRDGV

SEQ ID NO: 216938 - protein, 10 aa, Homo sapiens
LVVDFLSYKL

SEQ ID NO: 216939 - protein, 10 aa, Homo sapiens
VLVSRIAAWM

SEQ ID NO: 216940 - protein, 10 aa, Homo sapiens
SLDAREVIPM

SEQ ID NO: 216941 - protein, 10 aa, Homo sapiens
AINGNPSWHL

SEQ ID NO: 216942 - protein, 10 aa, Homo sapiens
RIAAWMATYL

SEQ ID NO: 216943 - protein, 10 aa, Homo sapiens
FFSFGGALCV

SEQ ID NO: 216944 - protein, 10 aa, Homo sapiens
VLLGSLFSRK

SEQ ID NO: 216945 - protein, 10 aa, Homo sapiens
TAYQSFEQVV

SEQ ID NO: 216946 - protein, 10 aa, Homo sapiens
ELYGNNAAAE

SEQ ID NO: 216947 - protein, 10 aa, Homo sapiens
GMTVAGVVLL

SEQ ID NO: 216948 - protein, 10 aa, Homo sapiens
FLTGMTVAGV

SEQ ID NO: 216949 - protein, 10 aa, Homo sapiens
YLNDHLEPWI

SEQ ID NO: 216950 - protein, 10 aa, Homo sapiens
SVDKEMQVLV

SEQ ID NO: 216951 - protein, 10 aa, Homo sapiens
WMATYLNDHL

SEQ ID NO: 216952 - protein, 10 aa, Homo sapiens
RIAAWMATYL

SEQ ID NO: 216953 - protein, 10 aa, Homo sapiens
AINGNPSWHL

SEQ ID NO: 216954 - protein, 10 aa, Homo sapiens
VLVSRIAAWM

SEQ ID NO: 216955 - protein, 10 aa, Homo sapiens
LVVDFLSYKL

SEQ ID NO: 216956 - protein, 10 aa, Homo sapiens
SLDAREVIPM

SEQ ID NO: 216957 - protein, 10 aa, Homo sapiens
GMTVAGVVLL

SEQ ID NO: 216958 - protein, 10 aa, Homo sapiens
TAYQSFEQVV

SEQ ID NO: 216959 - protein, 10 aa, Homo sapiens
FFSFGGALCV

SEQ ID NO: 216960 - protein, 10 aa, Homo sapiens
GTAYQSFEQV

SEQ ID NO: 216961 - protein, 10 aa, Homo sapiens
FLTGMTVAGV

SEQ ID NO: 216962 - protein, 10 aa, Homo sapiens
YLNDHLEPWI

SEQ ID NO: 216963 - protein, 10 aa, Homo sapiens
WMATYLNDHL

SEQ ID NO: 216964 - protein, 10 aa, Homo sapiens
AINGNPSWHL

SEQ ID NO: 216965 - protein, 10 aa, Homo sapiens
LVVDFLSYKL

SEQ ID NO: 216966 - protein, 10 aa, Homo sapiens
SVDKEMQVLV

SEQ ID NO: 216967 - protein, 10 aa, Homo sapiens
RIAAWMATYL

SEQ ID NO: 216968 - protein, 10 aa, Homo sapiens
SLDAREVIPM

SEQ ID NO: 216969 - protein, 10 aa, Homo sapiens
VLVSRIAAWM

SEQ ID NO: 216970 - protein, 10 aa, Homo sapiens
VLLGSLFSRK

SEQ ID NO: 216971 - protein, 10 aa, Homo sapiens
ELVVDFLSYK

SEQ ID NO: 216972 - protein, 10 aa, Homo sapiens
GALCVESVDK

SEQ ID NO: 216973 - protein, 10 aa, Homo sapiens
VVLLGSLFSR

SEQ ID NO: 216974 - protein, 10 aa, Homo sapiens
REVIPMAAVK

SEQ ID NO: 216975 - protein, 10 aa, Homo sapiens
VLLGSLFSRK

SEQ ID NO: 216976 - protein, 10 aa, Homo sapiens
VVLLGSLFSR

SEQ ID NO: 216977 - protein, 10 aa, Homo sapiens
GALCVESVDK

SEQ ID NO: 216978 - protein, 10 aa, Homo sapiens
SQFSDVEENR

SEQ ID NO: 216979 - protein, 10 aa, Homo sapiens
SFEQVVNELF

SEQ ID NO: 216980 - protein, 10 aa, Homo sapiens
TYLNDHLEPW

SEQ ID NO: 216981 - protein, 10 aa, Homo sapiens
SFEQVVNELF

SEQ ID NO: 216982 - protein, 10 aa, Homo sapiens
TYLNDHLEPW

SEQ ID NO: 216983 - protein, 10 aa, Homo sapiens
ITPGTAYQSF

SEQ ID NO: 216984 - protein, 10 aa, Homo sapiens
TYLNDHLEPW

SEQ ID NO: 216985 - protein, 10 aa, Homo sapiens
SFEQVVNELF

SEQ ID NO: 216986 - protein, 10 aa, Homo sapiens
ITPGTAYQSF

SEQ ID NO: 216987 - protein, 10 aa, Homo sapiens
EAPEGTESEM

SEQ ID NO: 216988 - protein, 10 aa, Homo sapiens
RIAAWMATYL

SEQ ID NO: 216989 - protein, 10 aa, Homo sapiens
ITPGTAYQSF

SEQ ID NO: 216990 - protein, 10 aa, Homo sapiens
VLVSRIAAWM

SEQ ID NO: 216991 - protein, 10 aa, Homo sapiens
EAPEGTESEM

SEQ ID NO: 216992 - protein, 10 aa, Homo sapiens
ESVDKEMQVL

SEQ ID NO: 216993 - protein, 10 aa, Homo sapiens
EFELRYRRAF

SEQ ID NO: 216994 - protein, 10 aa, Homo sapiens
QLHITPGTAY

SEQ ID NO: 216995 - protein, 10 aa, Homo sapiens
VVLLGSLFSR

SEQ ID NO: 216996 - protein, 10 aa, Homo sapiens
LFRDGVNWGR

SEQ ID NO: 216997 - protein, 10 aa, Homo sapiens
SRKGQERFNR

SEQ ID NO: 216998 - protein, 10 aa, Homo sapiens
PMAAVKQALR

SEQ ID NO: 216999 - protein, 10 aa, Homo sapiens
VVLLGSLFSR

SEQ ID NO: 217000 - protein, 10 aa, Homo sapiens
LFRDGVNWGR

SEQ ID NO: 217001 - protein, 10 aa, Homo sapiens
DFLSYKLSQK

SEQ ID NO: 217002 - protein, 10 aa, Homo sapiens
ELVVDFLSYK

SEQ ID NO: 217003 - protein, 10 aa, Homo sapiens
SQFSDVEENR

SEQ ID NO: 217004 - protein, 10 aa, Homo sapiens
VVLLGSLFSR

SEQ ID NO: 217005 - protein, 10 aa, Homo sapiens
YGNNAAAESR

SEQ ID NO: 217006 - protein, 10 aa, Homo sapiens
EVIPMAAVKQ

SEQ ID NO: 217007 - protein, 10 aa, Homo sapiens
MATYLNDHLE

SEQ ID NO: 217008 - protein, 10 aa, Homo sapiens
IVAFFSFGGA

SEQ ID NO: 217009 - protein, 10 aa, Homo sapiens
GTAYQSFEQV

SEQ ID NO: 217010 - protein, 10 aa, Homo sapiens
LVVDFLSYKL

SEQ ID NO: 217011 - protein, 10 aa, Homo sapiens
QSFEQVVNEL

SEQ ID NO: 217012 - protein, 10 aa, Homo sapiens
FLTGMTVAGV

SEQ ID NO: 217013 - protein, 10 aa, Homo sapiens
TAYQSFEQVV

SEQ ID NO: 217014 - protein, 10 aa, Homo sapiens
RIAAWMATYL

SEQ ID NO: 217015 - protein, 10 aa, Homo sapiens
NGATGHSSSL

SEQ ID NO: 217016 - protein, 10 aa, Homo sapiens
TVAGVVLLGS

SEQ ID NO: 217017 - protein, 10 aa, Homo sapiens
FGGALCVESV

SEQ ID NO: 217018 - protein, 10 aa, Homo sapiens
VVNELFRDGV

SEQ ID NO: 217019 - protein, 10 aa, Homo sapiens
LVSRIAAWMA

SEQ ID NO: 217020 - protein, 10 aa, Homo sapiens
TGMTVAGVVL

SEQ ID NO: 217021 - protein, 10 aa, Homo sapiens
SVDKEMQVLV

SEQ ID NO: 217022 - protein, 10 aa, Homo sapiens
FLTGMTVAGV

SEQ ID NO: 217023 - protein, 10 aa, Homo sapiens
TAYQSFEQVV

SEQ ID NO: 217024 - protein, 10 aa, Homo sapiens
LVVDFLSYKL

SEQ ID NO: 217025 - protein, 10 aa, Homo sapiens
RIAAWMATYL

SEQ ID NO: 217026 - protein, 10 aa, Homo sapiens
GTAYQSFEQV

SEQ ID NO: 217027 - protein, 10 aa, Homo sapiens
IPMAAVKQAL

SEQ ID NO: 217028 - protein, 10 aa, Homo sapiens
SQKGYSWSQF

SEQ ID NO: 217029 - protein, 10 aa, Homo sapiens
QLHITPGTAY

SEQ ID NO: 217030 - protein, 10 aa, Homo sapiens
GVNWGRIVAF

SEQ ID NO: 217031 - protein, 10 aa, Homo sapiens
IQENGGWDTF

SEQ ID NO: 217032 - protein, 10 aa, Homo sapiens
LSYKLSQKGY

SEQ ID NO: 217033 - protein, 10 aa, Homo sapiens
RELVVDFLSY

SEQ ID NO: 217034 - protein, 10 aa, Homo sapiens
SRIAAWMATY

SEQ ID NO: 217035 - protein, 10 aa, Homo sapiens
RRAFSDLTSQ

SEQ ID NO: 217036 - protein, 10 aa, Homo sapiens
IPMAAVKQAL

SEQ ID NO: 217037 - protein, 10 aa, Homo sapiens
EPWIQENGGW

SEQ ID NO: 217038 - protein, 10 aa, Homo sapiens
EAGDEFELRY

SEQ ID NO: 217039 - protein, 10 aa, Homo sapiens
EAPEGTESEM

SEQ ID NO: 217040 - protein, 10 aa, Homo sapiens
QALREAGDEF

SEQ ID NO: 217041 - protein, 10 aa, Homo sapiens
SPAVNGATGH

SEQ ID NO: 217042 - protein, 10 aa, Homo sapiens
TPSAINGNPS

SEQ ID NO: 217043 - protein, 10 aa, Homo sapiens
GVNWGRIVAF

SEQ ID NO: 217044 - protein, 10 aa, Homo sapiens
VAFFSFGGAL

SEQ ID NO: 217045 - protein, 10 aa, Homo sapiens
FVELYGNNAA

SEQ ID NO: 217046 - protein, 10 aa, Homo sapiens
AESRKGQERF

SEQ ID NO: 217047 - protein, 10 aa, Homo sapiens
EPWIQENGGW

SEQ ID NO: 217048 - protein, 10 aa, Homo sapiens
QSNRELVVDF

SEQ ID NO: 217049 - protein, 10 aa, Homo sapiens
QVLVSRIAAW

SEQ ID NO: 217050 - protein, 10 aa, Homo sapiens
PSAINGNPSW

SEQ ID NO: 217051 - protein, 11 aa, Homo sapiens
FLTGMTVAGVV

SEQ ID NO: 217052 - protein, 11 aa, Homo sapiens
SLDAREVIPMA

SEQ ID NO: 217053 - protein, 11 aa, Homo sapiens
VLVSRIAAWMA

SEQ ID NO: 217054 - protein, 11 aa, Homo sapiens
HLADSPAVNGA

SEQ ID NO: 217055 - protein, 11 aa, Homo sapiens
YLNDHLEPWIQ

SEQ ID NO: 217056 - protein, 11 aa, Homo sapiens
ALREAGDEFEL

SEQ ID NO: 217057 - protein, 11 aa, Homo sapiens
YQSFEQVVNEL

SEQ ID NO: 217058 - protein, 11 aa, Homo sapiens
HLADSPAVNGA

SEQ ID NO: 217059 - protein, 11 aa, Homo sapiens
FLTGMTVAGVV

SEQ ID NO: 217060 - protein, 11 aa, Homo sapiens
YQSFEQVVNEL

SEQ ID NO: 217061 - protein, 11 aa, Homo sapiens
ALREAGDEFEL

SEQ ID NO: 217062 - protein, 11 aa, Homo sapiens
YLNDHLEPWIQ

SEQ ID NO: 217063 - protein, 11 aa, Homo sapiens
IVAFFSFGGAL

SEQ ID NO: 217064 - protein, 11 aa, Homo sapiens
TVAGVVLLGSL

SEQ ID NO: 217065 - protein, 11 aa, Homo sapiens
VLVSRIAAWMA

SEQ ID NO: 217066 - protein, 11 aa, Homo sapiens
KLSQKGYSWSQ

SEQ ID NO: 217067 - protein, 11 aa, Homo sapiens
ELVVDFLSYKL

SEQ ID NO: 217068 - protein, 11 aa, Homo sapiens
SLDAREVIPMA

SEQ ID NO: 217069 - protein, 11 aa, Homo sapiens
FLTGMTVAGVV

SEQ ID NO: 217070 - protein, 11 aa, Homo sapiens
HLADSPAVNGA

SEQ ID NO: 217071 - protein, 11 aa, Homo sapiens
RIVAFFSFGGA

SEQ ID NO: 217072 - protein, 11 aa, Homo sapiens
VLVSRIAAWMA

SEQ ID NO: 217073 - protein, 11 aa, Homo sapiens
TVAGVVLLGSL

SEQ ID NO: 217074 - protein, 11 aa, Homo sapiens
ALREAGDEFEL

SEQ ID NO: 217075 - protein, 11 aa, Homo sapiens
YQSFEQVVNEL

SEQ ID NO: 217076 - protein, 11 aa, Homo sapiens
YLNDHLEPWIQ

SEQ ID NO: 217077 - protein, 11 aa, Homo sapiens
AINGNPSWHLA

SEQ ID NO: 217078 - protein, 11 aa, Homo sapiens
FNRWFLTGMTV

SEQ ID NO: 217079 - protein, 11 aa, Homo sapiens
IVAFFSFGGAL

SEQ ID NO: 217080 - protein, 11 aa, Homo sapiens
SLDAREVIPMA

SEQ ID NO: 217081 - protein, 11 aa, Homo sapiens
MAAVKQALREA

SEQ ID NO: 217082 - protein, 11 aa, Homo sapiens
QVVNELFRDGV

SEQ ID NO: 217083 - protein, 11 aa, Homo sapiens
FLTGMTVAGVV

SEQ ID NO: 217084 - protein, 11 aa, Homo sapiens
ALREAGDEFEL

SEQ ID NO: 217085 - protein, 11 aa, Homo sapiens
VLVSRIAAWMA

SEQ ID NO: 217086 - protein, 11 aa, Homo sapiens
YLNDHLEPWIQ

SEQ ID NO: 217087 - protein, 11 aa, Homo sapiens
SLDAREVIPMA

SEQ ID NO: 217088 - protein, 11 aa, Homo sapiens
FLTGMTVAGVV

SEQ ID NO: 217089 - protein, 11 aa, Homo sapiens
RIVAFFSFGGA

SEQ ID NO: 217090 - protein, 11 aa, Homo sapiens
IQENGGWDTFV

SEQ ID NO: 217091 - protein, 11 aa, Homo sapiens
YQSFEQVVNEL

SEQ ID NO: 217092 - protein, 11 aa, Homo sapiens
SAINGNPSWHL

SEQ ID NO: 217093 - protein, 11 aa, Homo sapiens
QVVNELFRDGV

SEQ ID NO: 217094 - protein, 11 aa, Homo sapiens
VLVSRIAAWMA

SEQ ID NO: 217095 - protein, 11 aa, Homo sapiens
KQALREAGDEF

SEQ ID NO: 217096 - protein, 11 aa, Homo sapiens
HLADSPAVNGA

SEQ ID NO: 217097 - protein, 11 aa, Homo sapiens
TVAGVVLLGSL

SEQ ID NO: 217098 - protein, 11 aa, Homo sapiens
ALREAGDEFEL

SEQ ID NO: 217099 - protein, 11 aa, Homo sapiens
SQLHITPGTAY

SEQ ID NO: 217100 - protein, 11 aa, Homo sapiens
FLTGMTVAGVV

SEQ ID NO: 217101 - protein, 11 aa, Homo sapiens
SLDAREVIPMA

SEQ ID NO: 217102 - protein, 11 aa, Homo sapiens
YLNDHLEPWIQ

SEQ ID NO: 217103 - protein, 11 aa, Homo sapiens
ALREAGDEFEL

SEQ ID NO: 217104 - protein, 11 aa, Homo sapiens
HLADSPAVNGA

SEQ ID NO: 217105 - protein, 11 aa, Homo sapiens
VLVSRIAAWMA

SEQ ID NO: 217106 - protein, 11 aa, Homo sapiens
KLSQKGYSWSQ

SEQ ID NO: 217107 - protein, 11 aa, Homo sapiens
ELVVDFLSYKL

SEQ ID NO: 217108 - protein, 11 aa, Homo sapiens
TVAGVVLLGSL

SEQ ID NO: 217109 - protein, 11 aa, Homo sapiens
AINGNPSWHLA

SEQ ID NO: 217110 - protein, 11 aa, Homo sapiens
WFLTGMTVAGV

SEQ ID NO: 217111 - protein, 11 aa, Homo sapiens
AFFSFGGALCV

SEQ ID NO: 217112 - protein, 11 aa, Homo sapiens
SFGGALCVESV

SEQ ID NO: 217113 - protein, 11 aa, Homo sapiens
VIPMAAVKQAL

SEQ ID NO: 217114 - protein, 11 aa, Homo sapiens
QVVNELFRDGV

SEQ ID NO: 217115 - protein, 11 aa, Homo sapiens
FRDGVNWGRIV

SEQ ID NO: 217116 - protein, 11 aa, Homo sapiens
SAINGNPSWHL

SEQ ID NO: 217117 - protein, 11 aa, Homo sapiens
ELYGNNAAAES

SEQ ID NO: 217118 - protein, 11 aa, Homo sapiens
CVESVDKEMQV

SEQ ID NO: 217119 - protein, 11 aa, Homo sapiens
GTAYQSFEQVV

SEQ ID NO: 217120 - protein, 11 aa, Homo sapiens
IVAFFSFGGAL

SEQ ID NO: 217121 - protein, 11 aa, Homo sapiens
FLTGMTVAGVV

SEQ ID NO: 217122 - protein, 11 aa, Homo sapiens
YLNDHLEPWIQ

SEQ ID NO: 217123 - protein, 11 aa, Homo sapiens
ALREAGDEFEL

SEQ ID NO: 217124 - protein, 11 aa, Homo sapiens
SLDAREVIPMA

SEQ ID NO: 217125 - protein, 11 aa, Homo sapiens
HLADSPAVNGA

SEQ ID NO: 217126 - protein, 11 aa, Homo sapiens
VLVSRIAAWMA

SEQ ID NO: 217127 - protein, 11 aa, Homo sapiens
VIPMAAVKQAL

SEQ ID NO: 217128 - protein, 11 aa, Homo sapiens
KLSQKGYSWSQ

SEQ ID NO: 217129 - protein, 11 aa, Homo sapiens
WFLTGMTVAGV

SEQ ID NO: 217130 - protein, 11 aa, Homo sapiens
ELVVDFLSYKL

SEQ ID NO: 217131 - protein, 11 aa, Homo sapiens
FRDGVNWGRIV

SEQ ID NO: 217132 - protein, 11 aa, Homo sapiens
FLTGMTVAGVV

SEQ ID NO: 217133 - protein, 11 aa, Homo sapiens
ALREAGDEFEL

SEQ ID NO: 217134 - protein, 11 aa, Homo sapiens
SLDAREVIPMA

SEQ ID NO: 217135 - protein, 11 aa, Homo sapiens
VLVSRIAAWMA

SEQ ID NO: 217136 - protein, 11 aa, Homo sapiens
CVESVDKEMQV

SEQ ID NO: 217137 - protein, 11 aa, Homo sapiens
HLADSPAVNGA

SEQ ID NO: 217138 - protein, 11 aa, Homo sapiens
SFGGALCVESV

SEQ ID NO: 217139 - protein, 11 aa, Homo sapiens
YLNDHLEPWIQ

SEQ ID NO: 217140 - protein, 11 aa, Homo sapiens
KLSQKGYSWSQ

SEQ ID NO: 217141 - protein, 11 aa, Homo sapiens
ELVVDFLSYKL

SEQ ID NO: 217142 - protein, 11 aa, Homo sapiens
TVAGVVLLGSL

SEQ ID NO: 217143 - protein, 11 aa, Homo sapiens
AFFSFGGALCV

SEQ ID NO: 217144 - protein, 11 aa, Homo sapiens
IQENGGWDTFV

SEQ ID NO: 217145 - protein, 11 aa, Homo sapiens
QVVNELFRDGV

SEQ ID NO: 217146 - protein, 11 aa, Homo sapiens
VIPMAAVKQAL

SEQ ID NO: 217147 - protein, 11 aa, Homo sapiens
ELYGNNAAAES

SEQ ID NO: 217148 - protein, 11 aa, Homo sapiens
SAINGNPSWHL

SEQ ID NO: 217149 - protein, 11 aa, Homo sapiens
WFLTGMTVAGV

SEQ ID NO: 217150 - protein, 11 aa, Homo sapiens
AINGNPSWHLA

SEQ ID NO: 217151 - protein, 11 aa, Homo sapiens
FLTGMTVAGVV

SEQ ID NO: 217152 - protein, 11 aa, Homo sapiens
HLADSPAVNGA

SEQ ID NO: 217153 - protein, 11 aa, Homo sapiens
YLNDHLEPWIQ

SEQ ID NO: 217154 - protein, 11 aa, Homo sapiens
SLDAREVIPMA

SEQ ID NO: 217155 - protein, 11 aa, Homo sapiens
ALREAGDEFEL

SEQ ID NO: 217156 - protein, 11 aa, Homo sapiens
WFLTGMTVAGV

SEQ ID NO: 217157 - protein, 11 aa, Homo sapiens
VLVSRIAAWMA

SEQ ID NO: 217158 - protein, 11 aa, Homo sapiens
VVLLGSLFSRK

SEQ ID NO: 217159 - protein, 11 aa, Homo sapiens
VVLLGSLFSRK

SEQ ID NO: 217160 - protein, 11 aa, Homo sapiens
GVVLLGSLFSR

SEQ ID NO: 217161 - protein, 11 aa, Homo sapiens
ATGHSSSLDAR

SEQ ID NO: 217162 - protein, 11 aa, Homo sapiens
RELVVDFLSYK

SEQ ID NO: 217163 - protein, 11 aa, Homo sapiens
NWGRIVAFFSF

SEQ ID NO: 217164 - protein, 11 aa, Homo sapiens
TYLNDHLEPWI

SEQ ID NO: 217165 - protein, 11 aa, Homo sapiens
AWMATYLNDHL

SEQ ID NO: 217166 - protein, 11 aa, Homo sapiens
SYKLSQKGYSW

SEQ ID NO: 217167 - protein, 11 aa, Homo sapiens
NWGRIVAFFSF

SEQ ID NO: 217168 - protein, 11 aa, Homo sapiens
TYLNDHLEPWI

SEQ ID NO: 217169 - protein, 11 aa, Homo sapiens
AWMATYLNDHL

SEQ ID NO: 217170 - protein, 11 aa, Homo sapiens
TYLNDHLEPWI

SEQ ID NO: 217171 - protein, 11 aa, Homo sapiens
AWMATYLNDHL

SEQ ID NO: 217172 - protein, 11 aa, Homo sapiens
SYKLSQKGYSW

SEQ ID NO: 217173 - protein, 11 aa, Homo sapiens
HITPGTAYQSF

SEQ ID NO: 217174 - protein, 11 aa, Homo sapiens
QVLVSRIAAWM

SEQ ID NO: 217175 - protein, 11 aa, Homo sapiens
HITPGTAYQSF

SEQ ID NO: 217176 - protein, 11 aa, Homo sapiens
WIQENGGWDTF

SEQ ID NO: 217177 - protein, 11 aa, Homo sapiens
FLSYKLSQKGY

SEQ ID NO: 217178 - protein, 11 aa, Homo sapiens
DGVNWGRIVAF

SEQ ID NO: 217179 - protein, 11 aa, Homo sapiens
TVAGVVLLGSL

SEQ ID NO: 217180 - protein, 11 aa, Homo sapiens
SQLHITPGTAY

SEQ ID NO: 217181 - protein, 11 aa, Homo sapiens
VVLLGSLFSRK

SEQ ID NO: 217182 - protein, 11 aa, Homo sapiens
RYRRAFSDLTS

SEQ ID NO: 217183 - protein, 11 aa, Homo sapiens
GVVLLGSLFSR

SEQ ID NO: 217184 - protein, 11 aa, Homo sapiens
SFEQVVNELFR

SEQ ID NO: 217185 - protein, 11 aa, Homo sapiens
ESRKGQERFNR

SEQ ID NO: 217186 - protein, 11 aa, Homo sapiens
ATGHSSSLDAR

SEQ ID NO: 217187 - protein, 11 aa, Homo sapiens
RELVVDFLSYK

SEQ ID NO: 217188 - protein, 11 aa, Homo sapiens
LYGNNAAAESR

SEQ ID NO: 217189 - protein, 11 aa, Homo sapiens
ESRKGQERFNR

SEQ ID NO: 217190 - protein, 11 aa, Homo sapiens
ELFRDGVNWGR

SEQ ID NO: 217191 - protein, 11 aa, Homo sapiens
EAGDEFELRYR

SEQ ID NO: 217192 - protein, 11 aa, Homo sapiens
SFEQVVNELFR

SEQ ID NO: 217193 - protein, 11 aa, Homo sapiens
GVVLLGSLFSR

SEQ ID NO: 217194 - protein, 11 aa, Homo sapiens
EFELRYRRAFS

SEQ ID NO: 217195 - protein, 11 aa, Homo sapiens
ELFRDGVNWGR

SEQ ID NO: 217196 - protein, 11 aa, Homo sapiens
WSQFSDVEENR

SEQ ID NO: 217197 - protein, 11 aa, Homo sapiens
ESRKGQERFNR

SEQ ID NO: 217198 - protein, 11 aa, Homo sapiens
EAGDEFELRYR

SEQ ID NO: 217199 - protein, 11 aa, Homo sapiens
GVVLLGSLFSR

SEQ ID NO: 217200 - protein, 11 aa, Homo sapiens
IPMAAVKQALR

SEQ ID NO: 217201 - protein, 11 aa, Homo sapiens
SFEQVVNELFR

SEQ ID NO: 217202 - protein, 11 aa, Homo sapiens
TVAGVVLLGSL

SEQ ID NO: 217203 - protein, 11 aa, Homo sapiens
QVVNELFRDGV

SEQ ID NO: 217204 - protein, 11 aa, Homo sapiens
IVAFFSFGGAL

SEQ ID NO: 217205 - protein, 11 aa, Homo sapiens
ESVDKEMQVLV

SEQ ID NO: 217206 - protein, 11 aa, Homo sapiens
TGMTVAGVVLL

SEQ ID NO: 217207 - protein, 11 aa, Homo sapiens
ELVVDFLSYKL

SEQ ID NO: 217208 - protein, 11 aa, Homo sapiens
RIVAFFSFGGA

SEQ ID NO: 217209 - protein, 11 aa, Homo sapiens
DTFVELYGNNA

SEQ ID NO: 217210 - protein, 11 aa, Homo sapiens
EVIPMAAVKQA

SEQ ID NO: 217211 - protein, 11 aa, Homo sapiens
GTAYQSFEQVV

SEQ ID NO: 217212 - protein, 11 aa, Homo sapiens
DAREVIPMAAV

SEQ ID NO: 217213 - protein, 11 aa, Homo sapiens
HLADSPAVNGA

SEQ ID NO: 217214 - protein, 11 aa, Homo sapiens
MTVAGVVLLGS

SEQ ID NO: 217215 - protein, 11 aa, Homo sapiens
ETPSAINGNPS

SEQ ID NO: 217216 - protein, 11 aa, Homo sapiens
FLTGMTVAGVV

SEQ ID NO: 217217 - protein, 11 aa, Homo sapiens
HSSSLDAREVI

SEQ ID NO: 217218 - protein, 11 aa, Homo sapiens
SAINGNPSWHL

SEQ ID NO: 217219 - protein, 11 aa, Homo sapiens
DAREVIPMAAV

SEQ ID NO: 217220 - protein, 11 aa, Homo sapiens
ESVDKEMQVLV

SEQ ID NO: 217221 - protein, 11 aa, Homo sapiens
HLADSPAVNGA

SEQ ID NO: 217222 - protein, 11 aa, Homo sapiens
PSWHLADSPAV

SEQ ID NO: 217223 - protein, 11 aa, Homo sapiens
WFLTGMTVAGV

SEQ ID NO: 217224 - protein, 11 aa, Homo sapiens
EVIPMAAVKQA

SEQ ID NO: 217225 - protein, 11 aa, Homo sapiens
ELVVDFLSYKL

SEQ ID NO: 217226 - protein, 11 aa, Homo sapiens
TVAGVVLLGSL

SEQ ID NO: 217227 - protein, 11 aa, Homo sapiens
DTFVELYGNNA

SEQ ID NO: 217228 - protein, 11 aa, Homo sapiens
IVAFFSFGGAL

SEQ ID NO: 217229 - protein, 11 aa, Homo sapiens
NPSWHLADSPA

SEQ ID NO: 217230 - protein, 11 aa, Homo sapiens
SPAVNGATGHS

SEQ ID NO: 217231 - protein, 11 aa, Homo sapiens
SQLHITPGTAY

SEQ ID NO: 217232 - protein, 11 aa, Homo sapiens
KQALREAGDEF

SEQ ID NO: 217233 - protein, 11 aa, Homo sapiens
SQSNRELVVDF

SEQ ID NO: 217234 - protein, 11 aa, Homo sapiens
YQSFEQVVNEL

SEQ ID NO: 217235 - protein, 11 aa, Homo sapiens
MQVLVSRIAAW

SEQ ID NO: 217236 - protein, 11 aa, Homo sapiens
VSRIAAWMATY

SEQ ID NO: 217237 - protein, 11 aa, Homo sapiens
FLSYKLSQKGY

SEQ ID NO: 217238 - protein, 11 aa, Homo sapiens
WIQENGGWDTF

SEQ ID NO: 217239 - protein, 11 aa, Homo sapiens
QSFEQVVNELF

SEQ ID NO: 217240 - protein, 11 aa, Homo sapiens
HITPGTAYQSF

SEQ ID NO: 217241 - protein, 11 aa, Homo sapiens
GVNWGRIVAFF

SEQ ID NO: 217242 - protein, 11 aa, Homo sapiens
DEFELRYRRAF

SEQ ID NO: 217243 - protein, 11 aa, Homo sapiens
REAGDEFELRY

SEQ ID NO: 217244 - protein, 11 aa, Homo sapiens
SQLHITPGTAY

SEQ ID NO: 217245 - protein, 11 aa, Homo sapiens
VESVDKEMQVL

SEQ ID NO: 217246 - protein, 11 aa, Homo sapiens
LEPWIQENGGW

SEQ ID NO: 217247 - protein, 11 aa, Homo sapiens
FNRWFLTGMTV

SEQ ID NO: 217248 - protein, 11 aa, Homo sapiens
RRAFSDLTSQL

SEQ ID NO: 217249 - protein, 11 aa, Homo sapiens
SRIAAWMATYL

SEQ ID NO: 217250 - protein, 11 aa, Homo sapiens
NPSWHLADSPA

SEQ ID NO: 217251 - protein, 11 aa, Homo sapiens
TPSAINGNPSW

SEQ ID NO: 217252 - protein, 11 aa, Homo sapiens
WIQENGGWDTF

SEQ ID NO: 217253 - protein, 11 aa, Homo sapiens
DGVNWGRIVAF

SEQ ID NO: 217254 - protein, 11 aa, Homo sapiens
YQSFEQVVNEL

SEQ ID NO: 217255 - protein, 11 aa, Homo sapiens
VESVDKEMQVL

SEQ ID NO: 217256 - protein, 11 aa, Homo sapiens
TESEMETPSAI

SEQ ID NO: 217257 - protein, 11 aa, Homo sapiens
EENRTEAPEGT

SEQ ID NO: 217258 - protein, 11 aa, Homo sapiens
TPSAINGNPSW

SEQ ID NO: 217259 - protein, 11 aa, Homo sapiens
NPSWHLADSPA

SEQ ID NO: 217260 - protein, 11 aa, Homo sapiens
ATYLNDHLEPW

SEQ ID NO: 217261 - protein, 11 aa, Homo sapiens
ATYLNDHLEPW

SEQ ID NO: 217262 - protein, 11 aa, Homo sapiens
QSFEQVVNELF

SEQ ID NO: 217263 - protein, 15 aa, Homo sapiens
RWFLTGMTVAGVVLL

SEQ ID NO: 217264 - protein, 9 aa, Homo sapiens
LTGMTVAGV

SEQ ID NO: 217265 - protein, 15 aa, Homo sapiens
RFNRWFLTGMTVAGV

SEQ ID NO: 217266 - protein, 9 aa, Homo sapiens
FLTGMTVAG

SEQ ID NO: 217267 - protein, 15 aa, Homo sapiens
FNRWFLTGMTVAGVV

SEQ ID NO: 217268 - protein, 9 aa, Homo sapiens
LTGMTVAGV

SEQ ID NO: 217269 - protein, 15 aa, Homo sapiens
NRWFLTGMTVAGVVL

SEQ ID NO: 217270 - protein, 9 aa, Homo sapiens
LTGMTVAGV

SEQ ID NO: 217271 - protein, 15 aa, Homo sapiens
WFLTGMTVAGVVLLG

SEQ ID NO: 217272 - protein, 9 aa, Homo sapiens
LTGMTVAGV

SEQ ID NO: 217273 - protein, 15 aa, Homo sapiens
DAREVIPMAAVKQAL

SEQ ID NO: 217274 - protein, 9 aa, Homo sapiens
VIPMAAVKQ

SEQ ID NO: 217275 - protein, 15 aa, Homo sapiens
AREVIPMAAVKQALR

SEQ ID NO: 217276 - protein, 9 aa, Homo sapiens
VIPMAAVKQ

SEQ ID NO: 217277 - protein, 15 aa, Homo sapiens
REVIPMAAVKQALRE

SEQ ID NO: 217278 - protein, 9 aa, Homo sapiens
VIPMAAVKQ

SEQ ID NO: 217279 - protein, 15 aa, Homo sapiens
LDAREVIPMAAVKQA

SEQ ID NO: 217280 - protein, 9 aa, Homo sapiens
VIPMAAVKQ

SEQ ID NO: 217281 - protein, 15 aa, Homo sapiens
KEMQVLVSRIAAWMA

SEQ ID NO: 217282 - protein, 9 aa, Homo sapiens
MQVLVSRIA

SEQ ID NO: 217283 - protein, 15 aa, Homo sapiens
LTSQLHITPGTAYQS

SEQ ID NO: 217284 - protein, 9 aa, Homo sapiens
LHITPGTAY

SEQ ID NO: 217285 - protein, 15 aa, Homo sapiens
TSQLHITPGTAYQSF

SEQ ID NO: 217286 - protein, 9 aa, Homo sapiens
ITPGTAYQS

SEQ ID NO: 217287 - protein, 15 aa, Homo sapiens
SLDAREVIPMAAVKQ

SEQ ID NO: 217288 - protein, 9 aa, Homo sapiens
AREVIPMAA

SEQ ID NO: 217289 - protein, 15 aa, Homo sapiens
SQLHITPGTAYQSFE

SEQ ID NO: 217290 - protein, 9 aa, Homo sapiens
ITPGTAYQS

SEQ ID NO: 217291 - protein, 15 aa, Homo sapiens
FLTGMTVAGVVLLGS

SEQ ID NO: 217292 - protein, 9 aa, Homo sapiens
LTGMTVAGV

SEQ ID NO: 217293 - protein, 15 aa, Homo sapiens
DKEMQVLVSRIAAWM

SEQ ID NO: 217294 - protein, 9 aa, Homo sapiens
MQVLVSRIA

SEQ ID NO: 217295 - protein, 15 aa, Homo sapiens
QLHITPGTAYQSFEQ

SEQ ID NO: 217296 - protein, 9 aa, Homo sapiens
ITPGTAYQS

SEQ ID NO: 217297 - protein, 15 aa, Homo sapiens
LHITPGTAYQSFEQV

SEQ ID NO: 217298 - protein, 9 aa, Homo sapiens
ITPGTAYQS

SEQ ID NO: 217299 - protein, 15 aa, Homo sapiens
SVDKEMQVLVSRIAA

SEQ ID NO: 217300 - protein, 9 aa, Homo sapiens
MQVLVSRIA

SEQ ID NO: 217301 - protein, 15 aa, Homo sapiens
EVIPMAAVKQALREA

SEQ ID NO: 217302 - protein, 9 aa, Homo sapiens
IPMAAVKQA

SEQ ID NO: 217303 - protein, 15 aa, Homo sapiens
ESVDKEMQVLVSRIA

SEQ ID NO: 217304 - protein, 9 aa, Homo sapiens
VDKEMQVLV

SEQ ID NO: 217305 - protein, 15 aa, Homo sapiens
VDKEMQVLVSRIAAW

SEQ ID NO: 217306 - protein, 9 aa, Homo sapiens
MQVLVSRIA

SEQ ID NO: 217307 - protein, 15 aa, Homo sapiens
LTGMTVAGVVLLGSL

SEQ ID NO: 217308 - protein, 9 aa, Homo sapiens
LTGMTVAGV

SEQ ID NO: 217309 - protein, 15 aa, Homo sapiens
ERFNRWFLTGMTVAG

SEQ ID NO: 217310 - protein, 9 aa, Homo sapiens
FNRWFLTGM

SEQ ID NO: 217311 - protein, 15 aa, Homo sapiens
ETPSAINGNPSWHLA

SEQ ID NO: 217312 - protein, 9 aa, Homo sapiens
INGNPSWHL

SEQ ID NO: 217313 - protein, 15 aa, Homo sapiens
TPSAINGNPSWHLAD

SEQ ID NO: 217314 - protein, 9 aa, Homo sapiens
INGNPSWHL

SEQ ID NO: 217315 - protein, 15 aa, Homo sapiens
PSAINGNPSWHLADS

SEQ ID NO: 217316 - protein, 9 aa, Homo sapiens
INGNPSWHL

SEQ ID NO: 217317 - protein, 15 aa, Homo sapiens
SAINGNPSWHLADSP

SEQ ID NO: 217318 - protein, 9 aa, Homo sapiens
INGNPSWHL

SEQ ID NO: 217319 - protein, 15 aa, Homo sapiens
METPSAINGNPSWHL

SEQ ID NO: 217320 - protein, 9 aa, Homo sapiens
PSAINGNPS

SEQ ID NO: 217321 - protein, 15 aa, Homo sapiens
EMQVLVSRIAAWMAT

SEQ ID NO: 217322 - protein, 9 aa, Homo sapiens
MQVLVSRIA

SEQ ID NO: 217323 - protein, 15 aa, Homo sapiens
VIPMAAVKQALREAG

SEQ ID NO: 217324 - protein, 9 aa, Homo sapiens
VIPMAAVKQ

SEQ ID NO: 217325 - protein, 15 aa, Homo sapiens
MQVLVSRIAAWMATY

SEQ ID NO: 217326 - protein, 9 aa, Homo sapiens
MQVLVSRIA

SEQ ID NO: 217327 - protein, 15 aa, Homo sapiens
VLVSRIAAWMATYLN

SEQ ID NO: 217328 - protein, 9 aa, Homo sapiens
IAAWMATYL

SEQ ID NO: 217329 - protein, 15 aa, Homo sapiens
GMTVAGVVLLGSLFS

SEQ ID NO: 217330 - protein, 9 aa, Homo sapiens
MTVAGVVLL

SEQ ID NO: 217331 - protein, 15 aa, Homo sapiens
MTVAGVVLLGSLFSR

SEQ ID NO: 217332 - protein, 9 aa, Homo sapiens
VVLLGSLFS

SEQ ID NO: 217333 - protein, 15 aa, Homo sapiens
INGNPSWHLADSPAV

SEQ ID NO: 217334 - protein, 9 aa, Homo sapiens
INGNPSWHL

SEQ ID NO: 217335 - protein, 15 aa, Homo sapiens
VELYGNNAAAESRKG

SEQ ID NO: 217336 - protein, 9 aa, Homo sapiens
YGNNAAAES

SEQ ID NO: 217337 - protein, 15 aa, Homo sapiens
TVAGVVLLGSLFSRK

SEQ ID NO: 217338 - protein, 9 aa, Homo sapiens
VVLLGSLFS

SEQ ID NO: 217339 - protein, 15 aa, Homo sapiens
QVLVSRIAAWMATYL

SEQ ID NO: 217340 - protein, 9 aa, Homo sapiens
VSRIAAWMA

SEQ ID NO: 217341 - protein, 15 aa, Homo sapiens
FVELYGNNAAAESRK

SEQ ID NO: 217342 - protein, 9 aa, Homo sapiens
YGNNAAAES

SEQ ID NO: 217343 - protein, 15 aa, Homo sapiens
ELYGNNAAAESRKGQ

SEQ ID NO: 217344 - protein, 9 aa, Homo sapiens
YGNNAAAES

SEQ ID NO: 217345 - protein, 15 aa, Homo sapiens
LRYRRAFSDLTSQLH

SEQ ID NO: 217346 - protein, 9 aa, Homo sapiens
YRRAFSDLT

SEQ ID NO: 217347 - protein, 15 aa, Homo sapiens
LVSRIAAWMATYLND

SEQ ID NO: 217348 - protein, 9 aa, Homo sapiens
IAAWMATYL

SEQ ID NO: 217349 - protein, 15 aa, Homo sapiens
TFVELYGNNAAAESR

SEQ ID NO: 217350 - protein, 9 aa, Homo sapiens
YGNNAAAES

SEQ ID NO: 217351 - protein, 15 aa, Homo sapiens
DTFVELYGNNAAAES

SEQ ID NO: 217352 - protein, 9 aa, Homo sapiens
FVELYGNNA

SEQ ID NO: 217353 - protein, 15 aa, Homo sapiens
NPSWHLADSPAVNGA

SEQ ID NO: 217354 - protein, 9 aa, Homo sapiens
WHLADSPAV

SEQ ID NO: 217355 - protein, 15 aa, Homo sapiens
PSWHLADSPAVNGAT

SEQ ID NO: 217356 - protein, 9 aa, Homo sapiens
WHLADSPAV

SEQ ID NO: 217357 - protein, 15 aa, Homo sapiens
TGMTVAGVVLLGSLF

SEQ ID NO: 217358 - protein, 9 aa, Homo sapiens
MTVAGVVLL

SEQ ID NO: 217359 - protein, 15 aa, Homo sapiens
VSRIAAWMATYLNDH

SEQ ID NO: 217360 - protein, 9 aa, Homo sapiens
IAAWMATYL

SEQ ID NO: 217361 - protein, 15 aa, Homo sapiens
GNPSWHLADSPAVNG

SEQ ID NO: 217362 - protein, 9 aa, Homo sapiens
WHLADSPAV

SEQ ID NO: 217363 - protein, 15 aa, Homo sapiens
LADSPAVNGATGHSS

SEQ ID NO: 217364 - protein, 9 aa, Homo sapiens
LADSPAVNG

SEQ ID NO: 217365 - protein, 15 aa, Homo sapiens
ELRYRRAFSDLTSQL

SEQ ID NO: 217366 - protein, 9 aa, Homo sapiens
YRRAFSDLT

SEQ ID NO: 217367 - protein, 15 aa, Homo sapiens
SRIAAWMATYLNDHL

SEQ ID NO: 217368 - protein, 9 aa, Homo sapiens
IAAWMATYL

SEQ ID NO: 217369 - protein, 15 aa, Homo sapiens
FELRYRRAFSDLTSQ

SEQ ID NO: 217370 - protein, 9 aa, Homo sapiens
YRRAFSDLT

SEQ ID NO: 217371 - protein, 15 aa, Homo sapiens
EFELRYRRAFSDLTS

SEQ ID NO: 217372 - protein, 9 aa, Homo sapiens
YRRAFSDLT

SEQ ID NO: 217373 - protein, 15 aa, Homo sapiens
DEFELRYRRAFSDLT

SEQ ID NO: 217374 - protein, 9 aa, Homo sapiens
LRYRRAFSD

SEQ ID NO: 217375 - protein, 15 aa, Homo sapiens
IVAFFSFGGALCVES

SEQ ID NO: 217376 - protein, 9 aa, Homo sapiens
FSFGGALCV

SEQ ID NO: 217377 - protein, 15 aa, Homo sapiens
SWHLADSPAVNGATG

SEQ ID NO: 217378 - protein, 9 aa, Homo sapiens
LADSPAVNG

SEQ ID NO: 217379 - protein, 15 aa, Homo sapiens
DSPAVNGATGHSSSL

SEQ ID NO: 217380 - protein, 9 aa, Homo sapiens
VNGATGHSS

SEQ ID NO: 217381 - protein, 15 aa, Homo sapiens
SPAVNGATGHSSSLD

SEQ ID NO: 217382 - protein, 9 aa, Homo sapiens
VNGATGHSS

SEQ ID NO: 217383 - protein, 15 aa, Homo sapiens
VAFFSFGGALCVESV

SEQ ID NO: 217384 - protein, 9 aa, Homo sapiens
FSFGGALCV

SEQ ID NO: 217385 - protein, 15 aa, Homo sapiens
ADSPAVNGATGHSSS

SEQ ID NO: 217386 - protein, 9 aa, Homo sapiens
VNGATGHSS

SEQ ID NO: 217387 - protein, 15 aa, Homo sapiens
AFFSFGGALCVESVD

SEQ ID NO: 217388 - protein, 9 aa, Homo sapiens
FSFGGALCV

SEQ ID NO: 217389 - protein, 15 aa, Homo sapiens
WHLADSPAVNGATGH

SEQ ID NO: 217390 - protein, 9 aa, Homo sapiens
LADSPAVNG

SEQ ID NO: 217391 - protein, 15 aa, Homo sapiens
HITPGTAYQSFEQVV

SEQ ID NO: 217392 - protein, 9 aa, Homo sapiens
ITPGTAYQS

SEQ ID NO: 217393 - protein, 15 aa, Homo sapiens
ITPGTAYQSFEQVVN

SEQ ID NO: 217394 - protein, 9 aa, Homo sapiens
ITPGTAYQS

SEQ ID NO: 217395 - protein, 15 aa, Homo sapiens
AINGNPSWHLADSPA

SEQ ID NO: 217396 - protein, 9 aa, Homo sapiens
INGNPSWHL

SEQ ID NO: 217397 - protein, 15 aa, Homo sapiens
PAVNGATGHSSSLDA

SEQ ID NO: 217398 - protein, 9 aa, Homo sapiens
VNGATGHSS

SEQ ID NO: 217399 - protein, 15 aa, Homo sapiens
RYRRAFSDLTSQLHI

SEQ ID NO: 217400 - protein, 9 aa, Homo sapiens
YRRAFSDLT

SEQ ID NO: 217401 - protein, 15 aa, Homo sapiens
YRRAFSDLTSQLHIT

SEQ ID NO: 217402 - protein, 9 aa, Homo sapiens
YRRAFSDLT

SEQ ID NO: 217403 - protein, 15 aa, Homo sapiens
NGNPSWHLADSPAVN

SEQ ID NO: 217404 - protein, 9 aa, Homo sapiens
WHLADSPAV

SEQ ID NO: 217405 - protein, 15 aa, Homo sapiens
GRIVAFFSFGGALCV

SEQ ID NO: 217406 - protein, 9 aa, Homo sapiens
IVAFFSFGG

SEQ ID NO: 217407 - protein, 15 aa, Homo sapiens
LYGNNAAAESRKGQE

SEQ ID NO: 217408 - protein, 9 aa, Homo sapiens
YGNNAAAES

SEQ ID NO: 217409 - protein, 15 aa, Homo sapiens
RIAAWMATYLNDHLE

SEQ ID NO: 217410 - protein, 9 aa, Homo sapiens
AAWMATYLN

SEQ ID NO: 217411 - protein, 15 aa, Homo sapiens
YGNNAAAESRKGQER

SEQ ID NO: 217412 - protein, 9 aa, Homo sapiens
YGNNAAAES

SEQ ID NO: 217413 - protein, 15 aa, Homo sapiens
RIVAFFSFGGALCVE

SEQ ID NO: 217414 - protein, 9 aa, Homo sapiens
FSFGGALCV

SEQ ID NO: 217415 - protein, 15 aa, Homo sapiens
FRDGVNWGRIVAFFS

SEQ ID NO: 217416 - protein, 9 aa, Homo sapiens
VNWGRIVAF

SEQ ID NO: 217417 - protein, 15 aa, Homo sapiens
FFSFGGALCVESVDK

SEQ ID NO: 217418 - protein, 9 aa, Homo sapiens
FSFGGALCV

SEQ ID NO: 217419 - protein, 15 aa, Homo sapiens
FSFGGALCVESVDKE

SEQ ID NO: 217420 - protein, 9 aa, Homo sapiens
FSFGGALCV

SEQ ID NO: 217421 - protein, 15 aa, Homo sapiens
RDGVNWGRIVAFFSF

SEQ ID NO: 217422 - protein, 9 aa, Homo sapiens
VNWGRIVAF

SEQ ID NO: 217423 - protein, 15 aa, Homo sapiens
DGVNWGRIVAFFSFG

SEQ ID NO: 217424 - protein, 9 aa, Homo sapiens
VNWGRIVAF

SEQ ID NO: 217425 - protein, 15 aa, Homo sapiens
IPMAAVKQALREAGD

SEQ ID NO: 217426 - protein, 9 aa, Homo sapiens
IPMAAVKQA

SEQ ID NO: 217427 - protein, 15 aa, Homo sapiens
RRAFSDLTSQLHITP

SEQ ID NO: 217428 - protein, 9 aa, Homo sapiens
FSDLTSQLH

SEQ ID NO: 217429 - protein, 15 aa, Homo sapiens
RAFSDLTSQLHITPG

SEQ ID NO: 217430 - protein, 9 aa, Homo sapiens
FSDLTSQLH

SEQ ID NO: 217431 - protein, 15 aa, Homo sapiens
HLADSPAVNGATGHS

SEQ ID NO: 217432 - protein, 9 aa, Homo sapiens
LADSPAVNG

SEQ ID NO: 217433 - protein, 15 aa, Homo sapiens
GVNWGRIVAFFSFGG

SEQ ID NO: 217434 - protein, 9 aa, Homo sapiens
VNWGRIVAF

SEQ ID NO: 217435 - protein, 14 aa, Homo sapiens
AAWMATYLNDHLEP

SEQ ID NO: 217436 - protein, 9 aa, Homo sapiens
IAAWMATYL

SEQ ID NO: 217437 - protein, 15 aa, Homo sapiens
AVNGATGHSSSLDAR

SEQ ID NO: 217438 - protein, 9 aa, Homo sapiens
VNGATGHSS

SEQ ID NO: 217439 - protein, 15 aa, Homo sapiens
VNWGRIVAFFSFGGA

SEQ ID NO: 217440 - protein, 9 aa, Homo sapiens
VNWGRIVAF

SEQ ID NO: 217441 - protein, 15 aa, Homo sapiens
ELVVDFLSYKLSQKG

SEQ ID NO: 217442 - protein, 9 aa, Homo sapiens
VVDFLSYKL

SEQ ID NO: 217443 - protein, 15 aa, Homo sapiens
ELFRDGVNWGRIVAF

SEQ ID NO: 217444 - protein, 9 aa, Homo sapiens
FRDGVNWGR

SEQ ID NO: 217445 - protein, 15 aa, Homo sapiens
VNGATGHSSSLDARE

SEQ ID NO: 217446 - protein, 9 aa, Homo sapiens
VNGATGHSS

SEQ ID NO: 217447 - protein, 15 aa, Homo sapiens
LFRDGVNWGRIVAFF

SEQ ID NO: 217448 - protein, 9 aa, Homo sapiens
VNWGRIVAF

SEQ ID NO: 217449 - protein, 15 aa, Homo sapiens
LVVDFLSYKLSQKGY

SEQ ID NO: 217450 - protein, 9 aa, Homo sapiens
LSYKLSQKG

SEQ ID NO: 217451 - protein, 15 aa, Homo sapiens
VVDFLSYKLSQKGYS

SEQ ID NO: 217452 - protein, 9 aa, Homo sapiens
LSYKLSQKG

SEQ ID NO: 217453 - protein, 15 aa, Homo sapiens
QERFNRWFLTGMTVA

SEQ ID NO: 217454 - protein, 9 aa, Homo sapiens
FNRWFLTGM

SEQ ID NO: 217455 - protein, 15 aa, Homo sapiens
ESEMETPSAINGNPS

SEQ ID NO: 217456 - protein, 9 aa, Homo sapiens
METPSAING

SEQ ID NO: 217457 - protein, 15 aa, Homo sapiens
GTESEMETPSAINGN

SEQ ID NO: 217458 - protein, 9 aa, Homo sapiens
METPSAING

SEQ ID NO: 217459 - protein, 15 aa, Homo sapiens
DLTSQLHITPGTAYQ

SEQ ID NO: 217460 - protein, 9 aa, Homo sapiens
LHITPGTAY

SEQ ID NO: 217461 - protein, 15 aa, Homo sapiens
EGTESEMETPSAING

SEQ ID NO: 217462 - protein, 9 aa, Homo sapiens
ESEMETPSA

SEQ ID NO: 217463 - protein, 15 aa, Homo sapiens
SEMETPSAINGNPSW

SEQ ID NO: 217464 - protein, 9 aa, Homo sapiens
METPSAING

SEQ ID NO: 217465 - protein, 15 aa, Homo sapiens
SDLTSQLHITPGTAY

SEQ ID NO: 217466 - protein, 9 aa, Homo sapiens
SQLHITPGT

SEQ ID NO: 217467 - protein, 15 aa, Homo sapiens
VDFLSYKLSQKGYSW

SEQ ID NO: 217468 - protein, 9 aa, Homo sapiens
LSYKLSQKG

SEQ ID NO: 217469 - protein, 15 aa, Homo sapiens
TESEMETPSAINGNP

SEQ ID NO: 217470 - protein, 9 aa, Homo sapiens
METPSAING

SEQ ID NO: 217471 - protein, 15 aa, Homo sapiens
AAWMATYLNDHLEPW

SEQ ID NO: 217472 - protein, 9 aa, Homo sapiens
AAWMATYLN

SEQ ID NO: 217473 - protein, 15 aa, Homo sapiens
DFLSYKLSQKGYSWS

SEQ ID NO: 217474 - protein, 9 aa, Homo sapiens
LSYKLSQKG

SEQ ID NO: 217475 - protein, 15 aa, Homo sapiens
AFSDLTSQLHITPGT

SEQ ID NO: 217476 - protein, 9 aa, Homo sapiens
FSDLTSQLH

SEQ ID NO: 217477 - protein, 15 aa, Homo sapiens
FSDLTSQLHITPGTA

SEQ ID NO: 217478 - protein, 9 aa, Homo sapiens
FSDLTSQLH

SEQ ID NO: 217479 - protein, 15 aa, Homo sapiens
WGRIVAFFSFGGALC

SEQ ID NO: 217480 - protein, 9 aa, Homo sapiens
IVAFFSFGG

SEQ ID NO: 217481 - protein, 15 aa, Homo sapiens
GQERFNRWFLTGMTV

SEQ ID NO: 217482 - protein, 9 aa, Homo sapiens
FNRWFLTGM

SEQ ID NO: 217483 - protein, 15 aa, Homo sapiens
LRYRRAFSDLTSQLH

SEQ ID NO: 217484 - protein, 9 aa, Homo sapiens
YRRAFSDLT

SEQ ID NO: 217485 - protein, 15 aa, Homo sapiens
FELRYRRAFSDLTSQ

SEQ ID NO: 217486 - protein, 9 aa, Homo sapiens
YRRAFSDLT

SEQ ID NO: 217487 - protein, 15 aa, Homo sapiens
EFELRYRRAFSDLTS

SEQ ID NO: 217488 - protein, 9 aa, Homo sapiens
YRRAFSDLT

SEQ ID NO: 217489 - protein, 15 aa, Homo sapiens
DEFELRYRRAFSDLT

SEQ ID NO: 217490 - protein, 9 aa, Homo sapiens
DEFELRYRR

SEQ ID NO: 217491 - protein, 15 aa, Homo sapiens
ELRYRRAFSDLTSQL

SEQ ID NO: 217492 - protein, 9 aa, Homo sapiens
YRRAFSDLT

SEQ ID NO: 217493 - protein, 15 aa, Homo sapiens
NGGWDTFVELYGNNA

SEQ ID NO: 217494 - protein, 9 aa, Homo sapiens
WDTFVELYG

SEQ ID NO: 217495 - protein, 15 aa, Homo sapiens
GGWDTFVELYGNNAA

SEQ ID NO: 217496 - protein, 9 aa, Homo sapiens
FVELYGNNA

SEQ ID NO: 217497 - protein, 15 aa, Homo sapiens
WDTFVELYGNNAAAE

SEQ ID NO: 217498 - protein, 9 aa, Homo sapiens
FVELYGNNA

SEQ ID NO: 217499 - protein, 15 aa, Homo sapiens
GWDTFVELYGNNAAA

SEQ ID NO: 217500 - protein, 9 aa, Homo sapiens
FVELYGNNA

SEQ ID NO: 217501 - protein, 15 aa, Homo sapiens
DTFVELYGNNAAAES

SEQ ID NO: 217502 - protein, 9 aa, Homo sapiens
FVELYGNNA

SEQ ID NO: 217503 - protein, 15 aa, Homo sapiens
RYRRAFSDLTSQLHI

SEQ ID NO: 217504 - protein, 9 aa, Homo sapiens
YRRAFSDLT

SEQ ID NO: 217505 - protein, 15 aa, Homo sapiens
YRRAFSDLTSQLHIT

SEQ ID NO: 217506 - protein, 9 aa, Homo sapiens
YRRAFSDLT

SEQ ID NO: 217507 - protein, 15 aa, Homo sapiens
ESVDKEMQVLVSRIA

SEQ ID NO: 217508 - protein, 9 aa, Homo sapiens
KEMQVLVSR

SEQ ID NO: 217509 - protein, 15 aa, Homo sapiens
VDKEMQVLVSRIAAW

SEQ ID NO: 217510 - protein, 9 aa, Homo sapiens
MQVLVSRIA

SEQ ID NO: 217511 - protein, 15 aa, Homo sapiens
ERFNRWFLTGMTVAG

SEQ ID NO: 217512 - protein, 9 aa, Homo sapiens
WFLTGMTVA

SEQ ID NO: 217513 - protein, 15 aa, Homo sapiens
SVDKEMQVLVSRIAA

SEQ ID NO: 217514 - protein, 9 aa, Homo sapiens
MQVLVSRIA

SEQ ID NO: 217515 - protein, 15 aa, Homo sapiens
RFNRWFLTGMTVAGV

SEQ ID NO: 217516 - protein, 9 aa, Homo sapiens
FLTGMTVAG

SEQ ID NO: 217517 - protein, 15 aa, Homo sapiens
FNRWFLTGMTVAGVV

SEQ ID NO: 217518 - protein, 9 aa, Homo sapiens
FLTGMTVAG

SEQ ID NO: 217519 - protein, 15 aa, Homo sapiens
KEMQVLVSRIAAWMA

SEQ ID NO: 217520 - protein, 9 aa, Homo sapiens
MQVLVSRIA

SEQ ID NO: 217521 - protein, 15 aa, Homo sapiens
DKEMQVLVSRIAAWM

SEQ ID NO: 217522 - protein, 9 aa, Homo sapiens
MQVLVSRIA

SEQ ID NO: 217523 - protein, 15 aa, Homo sapiens
NRWFLTGMTVAGVVL

SEQ ID NO: 217524 - protein, 9 aa, Homo sapiens
FLTGMTVAG

SEQ ID NO: 217525 - protein, 15 aa, Homo sapiens
AAWMATYLNDHLEPW

SEQ ID NO: 217526 - protein, 9 aa, Homo sapiens
WMATYLNDH

SEQ ID NO: 217527 - protein, 15 aa, Homo sapiens
SRIAAWMATYLNDHL

SEQ ID NO: 217528 - protein, 9 aa, Homo sapiens
WMATYLNDH

SEQ ID NO: 217529 - protein, 15 aa, Homo sapiens
RIAAWMATYLNDHLE

SEQ ID NO: 217530 - protein, 9 aa, Homo sapiens
WMATYLNDH

SEQ ID NO: 217531 - protein, 15 aa, Homo sapiens
IAAWMATYLNDHLEP

SEQ ID NO: 217532 - protein, 9 aa, Homo sapiens
WMATYLNDH

SEQ ID NO: 217533 - protein, 15 aa, Homo sapiens
VSRIAAWMATYLNDH

SEQ ID NO: 217534 - protein, 9 aa, Homo sapiens
AAWMATYLN

SEQ ID NO: 217535 - protein, 15 aa, Homo sapiens
TVAGVVLLGSLFSRK

SEQ ID NO: 217536 - protein, 9 aa, Homo sapiens
VVLLGSLFS

SEQ ID NO: 217537 - protein, 15 aa, Homo sapiens
RFNRWFLTGMTVAGV

SEQ ID NO: 217538 - protein, 9 aa, Homo sapiens
FLTGMTVAG

SEQ ID NO: 217539 - protein, 15 aa, Homo sapiens
FNRWFLTGMTVAGVV

SEQ ID NO: 217540 - protein, 9 aa, Homo sapiens
FLTGMTVAG

SEQ ID NO: 217541 - protein, 15 aa, Homo sapiens
NRWFLTGMTVAGVVL

SEQ ID NO: 217542 - protein, 9 aa, Homo sapiens
FLTGMTVAG

SEQ ID NO: 217543 - protein, 15 aa, Homo sapiens
ERFNRWFLTGMTVAG

SEQ ID NO: 217544 - protein, 9 aa, Homo sapiens
WFLTGMTVA

SEQ ID NO: 217545 - protein, 15 aa, Homo sapiens
AWMATYLNDHLEPWI

SEQ ID NO: 217546 - protein, 9 aa, Homo sapiens
WMATYLNDH

SEQ ID NO: 217547 - protein, 15 aa, Homo sapiens
RWFLTGMTVAGVVLL

SEQ ID NO: 217548 - protein, 9 aa, Homo sapiens
FLTGMTVAG

SEQ ID NO: 217549 - protein, 15 aa, Homo sapiens
DTFVELYGNNAAAES

SEQ ID NO: 217550 - protein, 9 aa, Homo sapiens
FVELYGNNA

SEQ ID NO: 217551 - protein, 15 aa, Homo sapiens
GWDTFVELYGNNAAA

SEQ ID NO: 217552 - protein, 9 aa, Homo sapiens
FVELYGNNA

SEQ ID NO: 217553 - protein, 15 aa, Homo sapiens
WMATYLNDHLEPWIQ

SEQ ID NO: 217554 - protein, 9 aa, Homo sapiens
WMATYLNDH

SEQ ID NO: 217555 - protein, 15 aa, Homo sapiens
WDTFVELYGNNAAAE

SEQ ID NO: 217556 - protein, 9 aa, Homo sapiens
FVELYGNNA

SEQ ID NO: 217557 - protein, 15 aa, Homo sapiens
GGWDTFVELYGNNAA

SEQ ID NO: 217558 - protein, 9 aa, Homo sapiens
FVELYGNNA

SEQ ID NO: 217559 - protein, 15 aa, Homo sapiens
NGGWDTFVELYGNNA

SEQ ID NO: 217560 - protein, 9 aa, Homo sapiens
GWDTFVELY

SEQ ID NO: 217561 - protein, 15 aa, Homo sapiens
TAYQSFEQVVNELFR

SEQ ID NO: 217562 - protein, 9 aa, Homo sapiens
YQSFEQVVN

SEQ ID NO: 217563 - protein, 15 aa, Homo sapiens
GTAYQSFEQVVNELF

SEQ ID NO: 217564 - protein, 9 aa, Homo sapiens
YQSFEQVVN

SEQ ID NO: 217565 - protein, 15 aa, Homo sapiens
TPGTAYQSFEQVVNE

SEQ ID NO: 217566 - protein, 9 aa, Homo sapiens
YQSFEQVVN

SEQ ID NO: 217567 - protein, 15 aa, Homo sapiens
PGTAYQSFEQVVNEL

SEQ ID NO: 217568 - protein, 9 aa, Homo sapiens
YQSFEQVVN

SEQ ID NO: 217569 - protein, 15 aa, Homo sapiens
ITPGTAYQSFEQVVN

SEQ ID NO: 217570 - protein, 9 aa, Homo sapiens
AYQSFEQVV

SEQ ID NO: 217571 - protein, 15 aa, Homo sapiens
VSRIAAWMATYLNDH

SEQ ID NO: 217572 - protein, 9 aa, Homo sapiens
AAWMATYLN

SEQ ID NO: 217573 - protein, 15 aa, Homo sapiens
LVSRIAAWMATYLND

SEQ ID NO: 217574 - protein, 9 aa, Homo sapiens
AAWMATYLN

SEQ ID NO: 217575 - protein, 15 aa, Homo sapiens
VLVSRIAAWMATYLN

SEQ ID NO: 217576 - protein, 9 aa, Homo sapiens
IAAWMATYL

SEQ ID NO: 217577 - protein, 15 aa, Homo sapiens
SRIAAWMATYLNDHL

SEQ ID NO: 217578 - protein, 9 aa, Homo sapiens
AAWMATYLN

SEQ ID NO: 217579 - protein, 15 aa, Homo sapiens
LRYRRAFSDLTSQLH

SEQ ID NO: 217580 - protein, 9 aa, Homo sapiens
YRRAFSDLT

SEQ ID NO: 217581 - protein, 15 aa, Homo sapiens
FELRYRRAFSDLTSQ

SEQ ID NO: 217582 - protein, 9 aa, Homo sapiens
YRRAFSDLT

SEQ ID NO: 217583 - protein, 15 aa, Homo sapiens
EFELRYRRAFSDLTS

SEQ ID NO: 217584 - protein, 9 aa, Homo sapiens
YRRAFSDLT

SEQ ID NO: 217585 - protein, 15 aa, Homo sapiens
RIAAWMATYLNDHLE

SEQ ID NO: 217586 - protein, 9 aa, Homo sapiens
AAWMATYLN

SEQ ID NO: 217587 - protein, 15 aa, Homo sapiens
AYQSFEQVVNELFRD

SEQ ID NO: 217588 - protein, 9 aa, Homo sapiens
YQSFEQVVN

SEQ ID NO: 217589 - protein, 15 aa, Homo sapiens
YQSFEQVVNELFRDG

SEQ ID NO: 217590 - protein, 9 aa, Homo sapiens
YQSFEQVVN

SEQ ID NO: 217591 - protein, 15 aa, Homo sapiens
ELRYRRAFSDLTSQL

SEQ ID NO: 217592 - protein, 9 aa, Homo sapiens
YRRAFSDLT

SEQ ID NO: 217593 - protein, 15 aa, Homo sapiens
SQKGYSWSQFSDVEE

SEQ ID NO: 217594 - protein, 9 aa, Homo sapiens
GYSWSQFSD

SEQ ID NO: 217595 - protein, 15 aa, Homo sapiens
DEFELRYRRAFSDLT

SEQ ID NO: 217596 - protein, 9 aa, Homo sapiens
LRYRRAFSD

SEQ ID NO: 217597 - protein, 15 aa, Homo sapiens
QKGYSWSQFSDVEEN

SEQ ID NO: 217598 - protein, 9 aa, Homo sapiens
WSQFSDVEE

SEQ ID NO: 217599 - protein, 15 aa, Homo sapiens
RYRRAFSDLTSQLHI

SEQ ID NO: 217600 - protein, 9 aa, Homo sapiens
YRRAFSDLT

SEQ ID NO: 217601 - protein, 15 aa, Homo sapiens
KGYSWSQFSDVEENR

SEQ ID NO: 217602 - protein, 9 aa, Homo sapiens
WSQFSDVEE

SEQ ID NO: 217603 - protein, 15 aa, Homo sapiens
IAAWMATYLNDHLEP

SEQ ID NO: 217604 - protein, 9 aa, Homo sapiens
AAWMATYLN

SEQ ID NO: 217605 - protein, 15 aa, Homo sapiens
GYSWSQFSDVEENRT

SEQ ID NO: 217606 - protein, 9 aa, Homo sapiens
WSQFSDVEE

SEQ ID NO: 217607 - protein, 15 aa, Homo sapiens
KEMQVLVSRIAAWMA

SEQ ID NO: 217608 - protein, 9 aa, Homo sapiens
VLVSRIAAW

SEQ ID NO: 217609 - protein, 15 aa, Homo sapiens
MQVLVSRIAAWMATY

SEQ ID NO: 217610 - protein, 9 aa, Homo sapiens
VLVSRIAAW

SEQ ID NO: 217611 - protein, 15 aa, Homo sapiens
EMQVLVSRIAAWMAT

SEQ ID NO: 217612 - protein, 9 aa, Homo sapiens
VLVSRIAAW

SEQ ID NO: 217613 - protein, 15 aa, Homo sapiens
DKEMQVLVSRIAAWM

SEQ ID NO: 217614 - protein, 9 aa, Homo sapiens
VLVSRIAAW

SEQ ID NO: 217615 - protein, 15 aa, Homo sapiens
QVLVSRIAAWMATYL

SEQ ID NO: 217616 - protein, 9 aa, Homo sapiens
VLVSRIAAW

SEQ ID NO: 217617 - protein, 15 aa, Homo sapiens
ETPSAINGNPSWHLA

SEQ ID NO: 217618 - protein, 9 aa, Homo sapiens
INGNPSWHL

SEQ ID NO: 217619 - protein, 15 aa, Homo sapiens
METPSAINGNPSWHL

SEQ ID NO: 217620 - protein, 9 aa, Homo sapiens
AINGNPSWH

SEQ ID NO: 217621 - protein, 15 aa, Homo sapiens
VDKEMQVLVSRIAAW

SEQ ID NO: 217622 - protein, 9 aa, Homo sapiens
MQVLVSRIA

SEQ ID NO: 217623 - protein, 15 aa, Homo sapiens
TPSAINGNPSWHLAD

SEQ ID NO: 217624 - protein, 9 aa, Homo sapiens
INGNPSWHL

SEQ ID NO: 217625 - protein, 15 aa, Homo sapiens
PSAINGNPSWHLADS

SEQ ID NO: 217626 - protein, 9 aa, Homo sapiens
INGNPSWHL

SEQ ID NO: 217627 - protein, 15 aa, Homo sapiens
VLVSRIAAWMATYLN

SEQ ID NO: 217628 - protein, 9 aa, Homo sapiens
VLVSRIAAW

SEQ ID NO: 217629 - protein, 15 aa, Homo sapiens
SAINGNPSWHLADSP

SEQ ID NO: 217630 - protein, 9 aa, Homo sapiens
INGNPSWHL

SEQ ID NO: 217631 - protein, 15 aa, Homo sapiens
LRYRRAFSDLTSQLH

SEQ ID NO: 217632 - protein, 9 aa, Homo sapiens
YRRAFSDLT

SEQ ID NO: 217633 - protein, 15 aa, Homo sapiens
RYRRAFSDLTSQLHI

SEQ ID NO: 217634 - protein, 9 aa, Homo sapiens
FSDLTSQLH

SEQ ID NO: 217635 - protein, 15 aa, Homo sapiens
YRRAFSDLTSQLHIT

SEQ ID NO: 217636 - protein, 9 aa, Homo sapiens
FSDLTSQLH

SEQ ID NO: 217637 - protein, 15 aa, Homo sapiens
INGNPSWHLADSPAV

SEQ ID NO: 217638 - protein, 9 aa, Homo sapiens
INGNPSWHL

SEQ ID NO: 217639 - protein, 15 aa, Homo sapiens
PSWHLADSPAVNGAT

SEQ ID NO: 217640 - protein, 9 aa, Homo sapiens
WHLADSPAV

SEQ ID NO: 217641 - protein, 15 aa, Homo sapiens
NPSWHLADSPAVNGA

SEQ ID NO: 217642 - protein, 9 aa, Homo sapiens
WHLADSPAV

SEQ ID NO: 217643 - protein, 15 aa, Homo sapiens
GNPSWHLADSPAVNG

SEQ ID NO: 217644 - protein, 9 aa, Homo sapiens
WHLADSPAV

SEQ ID NO: 217645 - protein, 15 aa, Homo sapiens
INGNPSWHLADSPAV

SEQ ID NO: 217646 - protein, 9 aa, Homo sapiens
SWHLADSPA

SEQ ID NO: 217647 - protein, 15 aa, Homo sapiens
NGNPSWHLADSPAVN

SEQ ID NO: 217648 - protein, 9 aa, Homo sapiens
WHLADSPAV

SEQ ID NO: 217649 - protein, 15 aa, Homo sapiens
SWHLADSPAVNGATG

SEQ ID NO: 217650 - protein, 9 aa, Homo sapiens
WHLADSPAV

SEQ ID NO: 217651 - protein, 15 aa, Homo sapiens
WHLADSPAVNGATGH

SEQ ID NO: 217652 - protein, 9 aa, Homo sapiens
WHLADSPAV

SEQ ID NO: 217653 - protein, 15 aa, Homo sapiens
RWFLTGMTVAGVVLL

SEQ ID NO: 217654 - protein, 9 aa, Homo sapiens
FLTGMTVAG

SEQ ID NO: 217655 - protein, 15 aa, Homo sapiens
WFLTGMTVAGVVLLG

SEQ ID NO: 217656 - protein, 9 aa, Homo sapiens
MTVAGVVLL

SEQ ID NO: 217657 - protein, 15 aa, Homo sapiens
FLTGMTVAGVVLLGS

SEQ ID NO: 217658 - protein, 9 aa, Homo sapiens
MTVAGVVLL

SEQ ID NO: 217659 - protein, 15 aa, Homo sapiens
KEMQVLVSRIAAWMA

SEQ ID NO: 217660 - protein, 9 aa, Homo sapiens
MQVLVSRIA

SEQ ID NO: 217661 - protein, 15 aa, Homo sapiens
FRDGVNWGRIVAFFS

SEQ ID NO: 217662 - protein, 9 aa, Homo sapiens
GVNWGRIVA

SEQ ID NO: 217663 - protein, 15 aa, Homo sapiens
DKEMQVLVSRIAAWM

SEQ ID NO: 217664 - protein, 9 aa, Homo sapiens
MQVLVSRIA

SEQ ID NO: 217665 - protein, 15 aa, Homo sapiens
VDKEMQVLVSRIAAW

SEQ ID NO: 217666 - protein, 9 aa, Homo sapiens
MQVLVSRIA

SEQ ID NO: 217667 - protein, 15 aa, Homo sapiens
RDGVNWGRIVAFFSF

SEQ ID NO: 217668 - protein, 9 aa, Homo sapiens
GVNWGRIVA

SEQ ID NO: 217669 - protein, 15 aa, Homo sapiens
SVDKEMQVLVSRIAA

SEQ ID NO: 217670 - protein, 9 aa, Homo sapiens
MQVLVSRIA

SEQ ID NO: 217671 - protein, 15 aa, Homo sapiens
MTVAGVVLLGSLFSR

SEQ ID NO: 217672 - protein, 9 aa, Homo sapiens
VVLLGSLFS

SEQ ID NO: 217673 - protein, 15 aa, Homo sapiens
TGMTVAGVVLLGSLF

SEQ ID NO: 217674 - protein, 9 aa, Homo sapiens
MTVAGVVLL

SEQ ID NO: 217675 - protein, 15 aa, Homo sapiens
FLTGMTVAGVVLLGS

SEQ ID NO: 217676 - protein, 9 aa, Homo sapiens
MTVAGVVLL

SEQ ID NO: 217677 - protein, 15 aa, Homo sapiens
GMTVAGVVLLGSLFS

SEQ ID NO: 217678 - protein, 9 aa, Homo sapiens
MTVAGVVLL

SEQ ID NO: 217679 - protein, 15 aa, Homo sapiens
RWFLTGMTVAGVVLL

SEQ ID NO: 217680 - protein, 9 aa, Homo sapiens
FLTGMTVAG

SEQ ID NO: 217681 - protein, 15 aa, Homo sapiens
LTGMTVAGVVLLGSL

SEQ ID NO: 217682 - protein, 9 aa, Homo sapiens
MTVAGVVLL

SEQ ID NO: 217683 - protein, 15 aa, Homo sapiens
WFLTGMTVAGVVLLG

SEQ ID NO: 217684 - protein, 9 aa, Homo sapiens
MTVAGVVLL

SEQ ID NO: 217685 - protein, 15 aa, Homo sapiens
DTFVELYGNNAAAES

SEQ ID NO: 217686 - protein, 9 aa, Homo sapiens
VELYGNNAA

SEQ ID NO: 217687 - protein, 15 aa, Homo sapiens
TFVELYGNNAAAESR

SEQ ID NO: 217688 - protein, 9 aa, Homo sapiens
YGNNAAAES

SEQ ID NO: 217689 - protein, 15 aa, Homo sapiens
FVELYGNNAAAESRK

SEQ ID NO: 217690 - protein, 9 aa, Homo sapiens
YGNNAAAES

SEQ ID NO: 217691 - protein, 15 aa, Homo sapiens
VELYGNNAAAESRKG

SEQ ID NO: 217692 - protein, 9 aa, Homo sapiens
YGNNAAAES

SEQ ID NO: 217693 - protein, 15 aa, Homo sapiens
TVAGVVLLGSLFSRK

SEQ ID NO: 217694 - protein, 9 aa, Homo sapiens
VVLLGSLFS

SEQ ID NO: 217695 - protein, 15 aa, Homo sapiens
ELYGNNAAAESRKGQ

SEQ ID NO: 217696 - protein, 9 aa, Homo sapiens
YGNNAAAES

SEQ ID NO: 217697 - protein, 15 aa, Homo sapiens
TVAGVVLLGSLFSRK

SEQ ID NO: 217698 - protein, 9 aa, Homo sapiens
VLLGSLFSR

SEQ ID NO: 217699 - protein, 15 aa, Homo sapiens
MTVAGVVLLGSLFSR

SEQ ID NO: 217700 - protein, 9 aa, Homo sapiens
VVLLGSLFS

SEQ ID NO: 217701 - protein, 15 aa, Homo sapiens
RELVVDFLSYKLSQK

SEQ ID NO: 217702 - protein, 9 aa, Homo sapiens
LVVDFLSYK

SEQ ID NO: 217703 - protein, 15 aa, Homo sapiens
ELVVDFLSYKLSQKG

SEQ ID NO: 217704 - protein, 9 aa, Homo sapiens
FLSYKLSQK

SEQ ID NO: 217705 - protein, 15 aa, Homo sapiens
KEMQVLVSRIAAWMA

SEQ ID NO: 217706 - protein, 9 aa, Homo sapiens
MQVLVSRIA

SEQ ID NO: 217707 - protein, 15 aa, Homo sapiens
DKEMQVLVSRIAAWM

SEQ ID NO: 217708 - protein, 9 aa, Homo sapiens
MQVLVSRIA

SEQ ID NO: 217709 - protein, 15 aa, Homo sapiens
RFNRWFLTGMTVAGV

SEQ ID NO: 217710 - protein, 9 aa, Homo sapiens
FNRWFLTGM

SEQ ID NO: 217711 - protein, 15 aa, Homo sapiens
SRIAAWMATYLNDHL

SEQ ID NO: 217712 - protein, 9 aa, Homo sapiens
WMATYLNDH

SEQ ID NO: 217713 - protein, 15 aa, Homo sapiens
FNRWFLTGMTVAGVV

SEQ ID NO: 217714 - protein, 9 aa, Homo sapiens
LTGMTVAGV

SEQ ID NO: 217715 - protein, 15 aa, Homo sapiens
LVVDFLSYKLSQKGY

SEQ ID NO: 217716 - protein, 9 aa, Homo sapiens
FLSYKLSQK

SEQ ID NO: 217717 - protein, 15 aa, Homo sapiens
NRELVVDFLSYKLSQ

SEQ ID NO: 217718 - protein, 9 aa, Homo sapiens
LVVDFLSYK

SEQ ID NO: 217719 - protein, 15 aa, Homo sapiens
VNWGRIVAFFSFGGA

SEQ ID NO: 217720 - protein, 9 aa, Homo sapiens
IVAFFSFGG

SEQ ID NO: 217721 - protein, 15 aa, Homo sapiens
SNRELVVDFLSYKLS

SEQ ID NO: 217722 - protein, 9 aa, Homo sapiens
LVVDFLSYK

SEQ ID NO: 217723 - protein, 15 aa, Homo sapiens
MQVLVSRIAAWMATY

SEQ ID NO: 217724 - protein, 9 aa, Homo sapiens
LVSRIAAWM

SEQ ID NO: 217725 - protein, 15 aa, Homo sapiens
VSRIAAWMATYLNDH

SEQ ID NO: 217726 - protein, 9 aa, Homo sapiens
IAAWMATYL

SEQ ID NO: 217727 - protein, 15 aa, Homo sapiens
EMQVLVSRIAAWMAT

SEQ ID NO: 217728 - protein, 9 aa, Homo sapiens
VLVSRIAAW

SEQ ID NO: 217729 - protein, 15 aa, Homo sapiens
RIAAWMATYLNDHLE

SEQ ID NO: 217730 - protein, 9 aa, Homo sapiens
WMATYLNDH

SEQ ID NO: 217731 - protein, 15 aa, Homo sapiens
NELFRDGVNWGRIVA

SEQ ID NO: 217732 - protein, 9 aa, Homo sapiens
LFRDGVNWG

SEQ ID NO: 217733 - protein, 15 aa, Homo sapiens
QVVNELFRDGVNWGR

SEQ ID NO: 217734 - protein, 9 aa, Homo sapiens
LFRDGVNWG

SEQ ID NO: 217735 - protein, 15 aa, Homo sapiens
VVNELFRDGVNWGRI

SEQ ID NO: 217736 - protein, 9 aa, Homo sapiens
LFRDGVNWG

SEQ ID NO: 217737 - protein, 15 aa, Homo sapiens
IAAWMATYLNDHLEP

SEQ ID NO: 217738 - protein, 9 aa, Homo sapiens
WMATYLNDH

SEQ ID NO: 217739 - protein, 15 aa, Homo sapiens
WGRIVAFFSFGGALC

SEQ ID NO: 217740 - protein, 9 aa, Homo sapiens
IVAFFSFGG

SEQ ID NO: 217741 - protein, 15 aa, Homo sapiens
NWGRIVAFFSFGGAL

SEQ ID NO: 217742 - protein, 9 aa, Homo sapiens
IVAFFSFGG

SEQ ID NO: 217743 - protein, 15 aa, Homo sapiens
QERFNRWFLTGMTVA

SEQ ID NO: 217744 - protein, 9 aa, Homo sapiens
FNRWFLTGM

SEQ ID NO: 217745 - protein, 15 aa, Homo sapiens
ERFNRWFLTGMTVAG

SEQ ID NO: 217746 - protein, 9 aa, Homo sapiens
FNRWFLTGM

SEQ ID NO: 217747 - protein, 15 aa, Homo sapiens
GRIVAFFSFGGALCV

SEQ ID NO: 217748 - protein, 9 aa, Homo sapiens
IVAFFSFGG

SEQ ID NO: 217749 - protein, 15 aa, Homo sapiens
VVDFLSYKLSQKGYS

SEQ ID NO: 217750 - protein, 9 aa, Homo sapiens
FLSYKLSQK

SEQ ID NO: 217751 - protein, 15 aa, Homo sapiens
VDKEMQVLVSRIAAW

SEQ ID NO: 217752 - protein, 9 aa, Homo sapiens
MQVLVSRIA

SEQ ID NO: 217753 - protein, 15 aa, Homo sapiens
AAWMATYLNDHLEPW

SEQ ID NO: 217754 - protein, 9 aa, Homo sapiens
WMATYLNDH

SEQ ID NO: 217755 - protein, 15 aa, Homo sapiens
QSNRELVVDFLSYKL

SEQ ID NO: 217756 - protein, 9 aa, Homo sapiens
LVVDFLSYK

SEQ ID NO: 217757 - protein, 15 aa, Homo sapiens
VNELFRDGVNWGRIV

SEQ ID NO: 217758 - protein, 9 aa, Homo sapiens
LFRDGVNWG

SEQ ID NO: 217759 - protein, 15 aa, Homo sapiens
GVNWGRIVAFFSFGG

SEQ ID NO: 217760 - protein, 9 aa, Homo sapiens
VNWGRIVAF

SEQ ID NO: 217761 - protein, 15 aa, Homo sapiens
ELFRDGVNWGRIVAF

SEQ ID NO: 217762 - protein, 9 aa, Homo sapiens
LFRDGVNWG

SEQ ID NO: 217763 - protein, 15 aa, Homo sapiens
GMTVAGVVLLGSLFS

SEQ ID NO: 217764 - protein, 9 aa, Homo sapiens
VAGVVLLGS

SEQ ID NO: 217765 - protein, 15 aa, Homo sapiens
EQVVNELFRDGVNWG

SEQ ID NO: 217766 - protein, 9 aa, Homo sapiens
VVNELFRDG

SEQ ID NO: 217767 - protein, 15 aa, Homo sapiens
RIVAFFSFGGALCVE

SEQ ID NO: 217768 - protein, 9 aa, Homo sapiens
IVAFFSFGG

SEQ ID NO: 217769 - protein, 15 aa, Homo sapiens
NRWFLTGMTVAGVVL

SEQ ID NO: 217770 - protein, 9 aa, Homo sapiens
LTGMTVAGV

SEQ ID NO: 217771 - protein, 15 aa, Homo sapiens
LRYRRAFSDLTSQLH

SEQ ID NO: 217772 - protein, 9 aa, Homo sapiens
YRRAFSDLT

SEQ ID NO: 217773 - protein, 15 aa, Homo sapiens
RYRRAFSDLTSQLHI

SEQ ID NO: 217774 - protein, 9 aa, Homo sapiens
FSDLTSQLH

SEQ ID NO: 217775 - protein, 9 aa, Homo sapiens
QLFEELQEL

SEQ ID NO: 217776 - protein, 10 aa, Homo sapiens
YLNDHLEPWI

SEQ ID NO: 217777 - protein, 9 aa, Artificial Sequence
  Artificial sequence
GLQHWVPEL

SEQ ID NO: 217778 - protein, 9 aa, Artificial Sequence
  Artificial sequence
GLAGDVSAV

SEQ ID NO: 217779 - protein, 9 aa, HCMV
NLVPMVATV

SEQ ID NO: 217780 - protein, 9 aa, HIV
ILKEPVHGV

SEQ ID NO: 217781 - protein, 9 aa, Artificial Sequence
  Artificial sequence
ALIAPVHAV

SEQ ID NO: 217782 - protein, 9 aa, Epstein Barr virus
GLCTLVAML

SEQ ID NO: 217783 - protein, 9 aa, HCMV
VTEHDTLLY

SEQ ID NO: 217784 - protein, 9 aa, Homo sapiens
IVDCLTEMY

SEQ ID NO: 217785 - protein, 10 aa, HCMV
TPRVTGGGAM

SEQ ID NO: 217786 - protein, 11 aa, HCMV
RPHERNGFTVL

SEQ ID NO: 217787 - protein, 10 aa, HIV
TPGPGVRYPL

SEQ ID NO: 217788 - protein, 14 aa, Homo sapiens
GLNDIFEAQKIEWH

SEQ ID NO: 217789 - protein, 13 aa, Homo sapiens
AGFKGEQGPKGEP

SEQ ID NO: 217790 - protein, 9 aa, CMV
QYDPVAALF

SEQ ID NO: 217791 - protein, 9 aa, CMV
VYALPLKML
